US011845788B2

(12) United States Patent
Barouch et al.

(10) Patent No.: US 11,845,788 B2
(45) Date of Patent: Dec. 19, 2023

(54) ANTIBODY THERAPIES FOR HUMAN IMMUNODEFICIENCY VIRUS (HIV)

(71) Applicant: Beth Israel Deaconess Medical Center, Inc., Boston, MA (US)

(72) Inventors: Dan H. Barouch, Newton, MA (US); Bruce A. Kerwin, Bainbridge Island, WA (US); Randal R. Ketchem, Snohomish, WA (US); Alison J. Gillespie, Seattle, WA (US); Christine C. Siska, Seattle, WA (US); Rutilio H. Clark, Bainbridge Island, WA (US); Julee A. Floyd, Seattle, WA (US); Jeremy M. Shaver, Lake Forest Park, WA (US); Richard S. Rogers, Seattle, WA (US)

(73) Assignee: Beth Israel Deaconess Medical Center, Inc., Boston, MA (US)

( * ) Notice: Subject to any disclaimer, the term of this patent is extended or adjusted under 35 U.S.C. 154(b) by 0 days.

(21) Appl. No.: 17/057,444

(22) PCT Filed: May 22, 2019

(86) PCT No.: PCT/US2019/033613
§ 371 (c)(1),
(2) Date: Nov. 20, 2020

(87) PCT Pub. No.: WO2019/226829
PCT Pub. Date: Nov. 28, 2019

(65) Prior Publication Data
US 2021/0206838 A1 Jul. 8, 2021

Related U.S. Application Data

(60) Provisional application No. 62/675,102, filed on May 22, 2018.

(51) Int. Cl.
*C07K 16/10* (2006.01)
*A61K 39/42* (2006.01)
*A61K 45/06* (2006.01)
*A61K 39/00* (2006.01)

(52) U.S. Cl.
CPC .......... *C07K 16/1045* (2013.01); *A61K 39/42* (2013.01); *A61K 45/06* (2013.01); *A61K 2039/505* (2013.01); *C07K 2317/14* (2013.01); *C07K 2317/41* (2013.01); *C07K 2317/76* (2013.01); *C07K 2317/94* (2013.01)

(58) Field of Classification Search
CPC .............. C07K 16/1045; C07K 16/1063
See application file for complete search history.

(56) References Cited

U.S. PATENT DOCUMENTS

| | | | |
|---|---|---|---|
| 5,500,362 A | 3/1996 | Robinson et al. | |
| 5,821,337 A | 10/1998 | Carter et al. | |
| 6,737,056 B1 | 5/2004 | Presta | |
| 9,017,691 B2 | 4/2015 | Barouch et al. | |
| 9,464,131 B2 | 10/2016 | Chan-Hui et al. | |
| 10,040,863 B2 | 8/2018 | Uda et al. | |
| 10,087,239 B2 | 10/2018 | Chan-Hui et al. | |
| 10,093,720 B2 | 10/2018 | Burton et al. | |
| 10,376,583 B2 | 8/2019 | Barouch | |
| 2005/0130125 A1 | 6/2005 | Zagyansky | |
| 2007/0298051 A1 | 12/2007 | Barouch et al. | |
| 2009/0215639 A1 | 8/2009 | Crea et al. | |
| 2009/0263382 A1 | 10/2009 | Ewert et al. | |
| 2011/0295365 A1 | 12/2011 | Hyde et al. | |
| 2012/0288502 A1 | 11/2012 | Diskin et al. | |
| 2013/0071406 A1 | 3/2013 | Goldenberg et al. | |
| 2013/0251726 A1 | 9/2013 | Mascola et al. | |
| 2014/0302080 A1 | 10/2014 | Barouch et al. | |
| 2014/0348791 A1 | 11/2014 | Barouch et al. | |
| 2015/0291935 A1 | 10/2015 | Barouch et al. | |
| 2016/0008374 A1 | 1/2016 | Geleziunas et al. | |
| 2016/0213779 A1 | 7/2016 | Barouch | |
| 2017/0190763 A1* | 7/2017 | Balakrishnan | A61P 31/18 |
| 2020/0129618 A1 | 4/2020 | Barouch | |
| 2021/0206838 A1 | 7/2021 | Barouch et al. | |

FOREIGN PATENT DOCUMENTS

| | | |
|---|---|---|
| EP | 3052132 B1 | 8/2016 |
| WO | WO-03/008332 A1 | 1/2003 |
| WO | WO-2004/044155 A2 | 5/2004 |
| WO | WO-2007/104792 A2 | 9/2007 |
| WO | WO-2012/030904 A2 | 3/2012 |
| WO | WO-2014/047261 A1 | 3/2014 |

(Continued)

OTHER PUBLICATIONS

Tiller, K. E., et al., 2017, Arginine mutations in antibody complementarity-determining regions display context-dependent affinity-specificity trade-offs, J. Biol. Chem. 292(40):16638-16652.*
Sela-Culang, I., et al., Oct. 2013, The structural basis of antibody-antigen recognition, Front. Immunol. 4, Article 302, pp. 1-13.*
Xiang, J., et al., 1995, Framework residues 71 and 93 of chimeric B72.3 antibody are major determinants of the conformation of heavy-chain hypervariable loops, J. Mol. Biol. 253:385-390.*
Althaus et al., "Dynamics of immune escape during HIV/SIV infection," PLOS Comput Biol. 4(7):e1000103 (2008) (9 pages).
Andrade et al., "Three distinct phases of HIV-1 RNA decay in treatment-naive patients receiving raltegravir-based antiretroviral therapy: ACTG A5248," J Infect Dis. 208(6):884-91 (2013).

(Continued)

Primary Examiner — Jeffrey S Parkin
(74) Attorney, Agent, or Firm — Clark & Elbing LLP

(57) ABSTRACT

Featured are PGT121 variant antibodies or fragments thereof, which can be administered, e.g., as antibody therapies for treating human immunodeficiency virus (HIV) infection. In particular, featured are methods of treating subjects infected with HIV and/or blocking HIV infections in subjects at risk of HIV transmission using the PGT121 variant antibodies or fragments thereof.

13 Claims, 18 Drawing Sheets

Specification includes a Sequence Listing.

(56) References Cited

FOREIGN PATENT DOCUMENTS

| WO | WO-2015/048770 A2 | 4/2015 |
|---|---|---|
| WO | WO-2015/051270 A1 | 4/2015 |
| WO | WO-2016/014484 A1 | 1/2016 |
| WO | WO-2016/149698 A2 | 9/2016 |
| WO | WO-2016/196740 A1 | 12/2016 |
| WO | WO-2017/074878 A1 | 5/2017 |
| WO | WO-2017/096221 A1 | 6/2017 |
| WO | WO-2017/106346 A2 | 6/2017 |
| WO | WO-2019/226829 A1 | 11/2019 |
| WO | WO-2020/106713 A1 | 5/2020 |

OTHER PUBLICATIONS

Bansal, "A summary of the workshop on passive immunization using monoclonal antibodies for HIV/AIDS, held at the National Institute of Allergy and Infectious Diseases, Bethesda, Mar. 10, 2006," Biologicals. 35(4):367-71 (2007).
Barouch et al., "Protective efficacy of a global HIV-1 mosaic vaccine against heterologous SHIV challenges in rhesus monkeys," available in PMC Oct. 24, 2014, published in final edited form as: Cell. 155(3):531-9 (2013) (16 pages).
Barouch et al., "Vaccine protection against acquisition of neutralization-resistant SIV challenges in rhesus monkeys," available in PMC Aug. 2, 2012, published in final edited form as: Nature. 482(7383):89-93 (2012) (17 pages).
Barouch, et al., "Therapeutic efficacy of potent neutralizing HIV-1-specific monoclonal antibodies in SHIV-infected rhesus monkeys," available in PMC May 14, 2014, published in final edited form as: Nature. 503(7475):224-228 (2013) (24 pages).
Battistini et al., "HIV-1 latency: an update of molecular mechanisms and therapeutic strategies," Viruses. 6(4):1715-58 (2014).
Brooks et al., "Chapter 11: Clearance of Latent Reservoirs." *HIV Chemotherapy: A Critical Review.* Salvatore T. Butera, Calster Academic Press, 281-303 (2005) (24 pages).
Bruel et al., "Elimination of HIV-1-infected cells by broadly neutralizing antibodies," Nat Commun. 7:10844 (2016) (12 pages).
Burton et al., "Broadly neutralizing antibodies suggest new prospects to counter highly antigenically diverse viruses," available in PMC Jul. 13, 2013, published in final edited form as: Science. 337(6091):183-186 (2012) (13 pages).
Burton et al., "Efficient neutralization of primary isolates of HIV-1 by a recombinant human monoclonal antibody," Science. 266(5187):1024-7 (1994) (5 pages).
Chatellier et al., "Functional mapping of conserved residues located at the VL and VH domain interface of a fab," J Mol Biol. 264(1):1-6 (1996).
Chen et al., "Generation and analysis of random point mutations in an antibody CDR2 sequence: many mutated antibodies lose their ability to bind antigen," J Exp Med. 176(3):855-66 (1992).
De Boer et al., "Current estimates for HIV-1 production imply rapid viral clearance in lymphoid tissues," PLoS Comput Biol. 6(9):e1000906 (2010) (9 pages).
Deshpande et al., "HIV-1 clade C escapes broadly neutralizing autologous antibodies with N332 glycan specificity by distinct mechanisms," Retrovirology. 13(1):60 (2016) (9 pages).
Diskin et al., "Increasing the potency and breadth of an HIV antibody by using structure-based rational design," Science. 334(6060):1289-93 (2011) (10 pages).
Diskin et al., "Restricting HIV-1 pathways for escape using rationally designed anti-HIV-1 antibodies," J Exp Med. 210(6):1235-49 (2013).
Gama et al., "Reactivation of simian immunodeficiency virus reservoirs in the brain of virally suppressed macaques," AIDS. 31(1):5-14 (2017).
Gautam et al., "Pathogenicity and mucosal transmissibility of the R5-tropic simian/human immunodeficiency virus SHIV(AD8) in rhesus macaques: implications for use in vaccine studies," J Virol. 86(16):8516-26 (2012) (11 pages).

Hansen et al., "Profound early control of highly pathogenic SIV by an effector memory T-cell vaccine," Nature. 473(7348):523-7 (2011).
Hatziioannou et al., "Animal models for HIV/AIDS research," available in PMC Feb. 19, 2015, published in final edited form as: Nat Rev Microbiol. 10(12):852-867 (2012) (37 pages).
Hellerstein et al., "Directly measured kinetics of circulating T lymphocytes in normal and HIV-1-infected humans," Nat Med. 5(1):83-9 (1999).
Ho et al., "Rapid turnover of plasma virions and CD4 lymphocytes in HIV-1 infection," Nature. 373:123-126 (1995).
Horwitz et al., "HIV-1 suppression and durable control by combining single broadly neutralizing antibodies and antiretroviral drugs in humanized mice," Proc Natl Acad Sci U S A. 110(41):16538-43 (2013) (6 pages).
Huang et al., "Broad and potent neutralization of HIV-1 by a gp41-specific human antibody," Nature. 491(7424):406-12 (2012).
Igarashi et al., "Human immunodeficiency virus type 1 neutralizing antibodies accelerate clearance of cell-free virions from blood plasma," Nat Med. 5(2):211-6 (1999).
International Search Report and Written Opinion for International Application No. PCT/US2019/33613, dated Sep. 20, 2019 (27 pages).
Jaworski et al., "Neutralizing polyclonal IgG present during acute infection prevents rapid disease onset in simian-human immunodeficiency virus SHIVSF162P3-infected infant rhesus macaques," J Virol. 87(19):10447-59 (2013) (13 pages).
Jayaraman et al., "Evidence for persistent, occult infection in neonatal macaques following perinatal transmission of simian-human immunodeficiency virus SF162P3," J Virol. 81(2):822-34 (2007) (13 pages).
Julien et al., "Broadly neutralizing antibody PGT121 allosterically modulates CD4 binding via recognition of the HIV-1 gp120 V3 base and multiple surrounding glycans," PLoS Pathog. 9(5):e1003342 (2013) (15 pages).
Kala et al., "Phage displayed antibodies to heat stable alkaline phosphatase: framework region as a determinant of specificity," J Biochem. 132(4):535-41 (2002).
Kirschner et al., "Model of HIV-1 disease progression based on virus-induced lymph node homing and homing-induced apoptosis of CD4+ lymphocytes," J Acquir Immune Defic Syndr. 24(4):352-62 (2000).
Kirschner et al., "Role of the thymus in pediatric HIV-1 infection," J Acquir Immune Defic Syndr Hum Retrovirol. 18(2):95-109 (1998).
Klein et al., "Antibodies in HIV-1 vaccine development and therapy," available in PMC Mar. 31, 2014, published in final edited form as: Science. 341(6151):1199-1204 (2013) (17 pages).
Klein et al., "HIV therapy by a combination of broadly neutralizing antibodies in humanized mice," Nature. 492(7427):118-22 (2012).
Klein et al., "Somatic mutations of the immunoglobulin framework are generally required for broad and potent HIV-1 neutralization," Cell. 153(1):126-38 (2013).
Kong et al., "Supersite of immune vulnerability on the glycosylated face of HIV-1 envelope glycoprotein gp120," Nat Struct Mol Biol. 20(7):796-803 (2013) (22 pages).
Kraft et al., "Macaques infected with a CCR5-tropic simian/human immunodeficiency virus (SHIV) develop broadly reactive anti-HIV neutralizing antibodies," J Virol. 81(12):6402-11 (2007) (10 pages).
Kwong et al., "Broadly neutralizing antibodies and the search for an HIV-1 vaccine: the end of the beginning," Nat Rev Immunol. 13(9):693-701 (2013).
Le Douce et al., "Achieving a cure for HIV infection: do we have reasons to be optimistic?" J Antimicrob Chemother. 67(5):1063-74 (2012).
Letvin et al., "Immune and genetic correlates of vaccine protection against mucosal infection by SIV in monkeys," Sci Transl Med. 3(81): 81ra36 (2011) (22 pages).
Li et al., "Durable mucosal simian immunodeficiency virus-specific effector memory T lymphocyte responses elicited by recombinant adenovirus vectors in rhesus monkeys," J Virol. 85(21):11007-15 (2011).
Lim et al., "TRIM5alpha modulates immunodeficiency virus control in Rhesus monkeys," PLos Pathog. 6(1):e1000738 (2010) (11 pages).

(56) References Cited

OTHER PUBLICATIONS

Liu et al., "Fine mapping of the antigen-antibody interaction of scFv215, a recombinant antibody inhibiting RNA polymerase II from *Drosophila melanogaster*," J Mol Recognit. 12(2):103-11 (1999).
Liu et al., "Immune control of an SIV challenge by a T-cell-based vaccine in rhesus monkeys," available in PMC Jul. 1, 2009, published in final edited form as: Nature. 457(7225):87-91 (2009) (17 pages).
Liu et al., "Magnitude and phenotype of cellular immune responses elicited by recombinant adenovirus vectors and heterologous prime-boost regimens in rhesus monkeys," J Virol. 82(10):4844-52 (2008).
Loffredo et al., "Mamu-B*08-positive macaques control simian immunodeficiency virus replication," J Virol. 81(16):8827-32 (2007).
McLellan et al., "Structure of HIV-1 gp120 V1/V2 domain with broadly neutralizing antibody PG9," available in PMC Dec. 15, 2012, published in final edited form as: Nature. 480(7377):336-343 (2011) (17 pages).
Mehandru et al., "Adjunctive passive immunotherapy in human immunodeficiency virus type 1-infected individuals treated with antiviral therapy during acute and early infection," J Virol. 81(20):11016-31 (2007).
Mendoza et al., "Combination therapy with anti-HIV-1 antibodies maintains viral suppression," available in PMC Mar. 26, 2019, published in final edited form as: Nature. 561(7724):479-84 (2018) (33 pages).
Mothe et al., "Expression of the major histocompatibility complex class I molecule Mamu-A*01 is associated with control of simian immunodeficiency virus SIVmac239 replication," J Virol. 77(4):2736-40 (2003).
Mouquet et al., "Complex-type N-glycan recognition by potent broadly neutralizing HIV antibodies," Proc Natl Acad Sci U.S.A. 109(47):E3268-77 (2012).
Mouquet et al., Supplementary information for "Complex-type N-glycan recognition by potent broadly neutralizing HIV antibodies," Proc Natl Acad Sci U S A. 109(47):E3268-77 (2012) (54 pages).
NCBI Blast for Accesion No. NP_00607.1, retrieved May 10, 2016 (4 pages).
Ng et al., "Passive neutralizing antibody controls SHIV viremia and enhances B cell responses in infant macaques," available in PMC Apr. 3, 2011, published in final edited form as: Nat Med. 16(10):1117-1119 (2010) (14 pages).
Nishimura et al., "Generation of the pathogenic R5-tropic simian/human immunodeficiency virus SHIVAD8 by serial passaging in rhesus macaques," J Virol. 84(9):4769-81 (2010) (13 pages).
Okoye et al., "Progressive CD4+ central-memory T cell decline results in CD4+ effector-memory insufficiency and overt disease in chronic SIV infection," J Exp Med. 204(9):2171-85 (2007).
Pejchal et al., "A potent and broad neutralizing antibody recognizes and penetrates the HIV glycan shield," available in PMC Nov. 25, 2012, published in final edited form as: Science. 334(6059):1097-1103 (2011) (16 pages).
Perelson et al., "Dynamics of HIV infection of CD4+ T cells," Math Biosci. 114(1):81-125 (1993).
Perelson et al., "HIV-1 dynamics in vivo: virion clearance rate, infected cell life-span, and viral generation time," Science. 271(5255):1582-6 (1996).
Pitcher et al., "Development and homeostasis of t cell memory in rhesus macaque," J Immunol. 168(1):29-43 (2002) (16 pages).
Poignard et al., "Neutralizing antibodies have limited effects on the control of established HIV-1 infection in vivo," Immunity. 10(4):431-8 (1999).
Rajpal et al., "A general method for greatly improving the affinity of antibodies by using combinatorial libraries," Proc Natl Acad Sci U S A. 102(24):8466-71 (2005).
Roben et al., "Recognition properties of a panel of human recombinant Fab fragments to the CD4 binding site of gp120 that show differing abilities to neutralize human immunodeficiency virus type 1," J Virol. 68(8):4821-8 (1994).
Sadjadpour et al., "Emergence of gp120 V3 variants confers neutralization resistance in an R5 simian-human immunodeficiency virus-infected macaque elite neutralizer that targets the N332 glycan of the human immunodeficiency virus type 1 envelope glycoprotein," J Virol. 87(15):8798-804 (2013).
Scheid et al., "Broad diversity of neutralizing antibodies isolated from memory B cells in HIV-infected individuals," Nature. 458(7238):636-40 (2009).
Scheid et al., "Sequence and structural convergence of broad and potent HIV antibodies that mimic CD4 binding." Science. 333(6049):1633-7 (2011).
Shan et al., "From reactivation of latent HIV-1 to elimination of the latent reservoir: the presence of multiple barriers to viral eradication," available in PMC Apr. 6, 2015, published in final edited form as: Bioessays. 35(6):544-52 (2013) (17 pages).
Shan et al., "Unique characteristics of histone deacetylase inhibitors in reactivation of latent HIV-1 in Bcl-2-transduced primary resting CD4+ T cells," J Antimicrob Chemother. 69(1):28-33 (2014).
Sievers et al., "Antibody engineering for increased potency, breadth and half-life," Curr Opin HIV AIDS. 10(3):151-9 (2015).
Siliciano et al., "HIV Latency," Cold Spring Harb Perspect Med. 1(1):a007096 (2011) (19 pages).
Sok et al., "The effects of somatic hypermutation on neutralization and binding in the PGT121 family of broadly neutralizing HIV antibodies," PLoS Pathog. 9(11):e1003754 (2013) (20 pages).
Stephenson et al., "Gag-specific cellular immunity determines in vitro viral inhibition and in vivo virologic control following simian immunodeficiency virus challenges of vaccinated rhesus monkeys," J Virol. 86(18):9583-9 (2012) (7 pages).
Supplementary Information for Walker et al., "Broad neutralization coverage of HIV by multiple highly potent antibodies," Nature. 477(7365):466-470 (2011) (15 pages).
Trkola et al., "Delay of HIV-1 rebound after cessation of antiretroviral therapy through passive transfer of human neutralizing antibodies," Nat Med. 11(6):615-22 (2005) (8 pages).
van den Kerkhof et al., "HIV-1 escapes from N332-directed antibody neutralization in an elite neutralizer by envelope glycoprotein elongation and introduction of unusual disulfide bonds," Retrovirology. 13(1):48 (2016) (19 pages).
Walker et al., "Broad and potent neutralizing antibodies from an African donor reveal a new HIV-1 vaccine target," Science. 326(5950):285-9 (2009).
Walker et al., "Broad neutralization coverage of HIV by multiple highly potent antibodies," available in PMC Jul. 10, 2012, published in final edited form as: Nature. 477(7365):466-70 (2011) (14 pages).
Walker et al., "Broad neutralization coverage of HIV by multiple highly potent antibodies," Nature. 477(7365):466-470 (2011) (20 pages).
West et al., "Computational analysis of anti-HIV-1 antibody neutralization panel data to identify potential functional epitope residues," Proc Natl Acad Sci USA. 110(26):10598-603 (2013).
Whitney et al., "T-cell vaccination reduces simian immunodeficiency virus levels in semen," J Virol. 83(20):10840-3 (2009).
Wu et al., "Rational design of envelope identifies broadly neutralizing human monoclonal antibodies to HIV-1," Science. 329(5993):856-61 (2010).
Yant et al., "The high-frequency major histocompatibility complex class I allele Mamu-B*17 is associated with control of simian immunodeficiency virus SIVmac239 replication," J Virol. 80(10):5074-7 (2006).
Yu et al., "Predicting the broadly neutralizing antibody susceptibility of the HIV reservoir," JCI Insight. 4(17):e130153 (2019) (18 pages).
Zhou et al., "Structural basis for broad and potent neutralization of HIV-1 by antibody VRC01," available in PMC Aug. 13, 2011, published in final edited format as: Science. 329(5993):811-7 (2010) (19 pages).
Appendix: Chain Variable Region Alignments to Response to Office Action for U.S. Appl. No. 15/025,961, dated Apr. 2, 2018 (3 Pages).
Barnes et al., "Structural characterization of a highly-potent V3-glycan broadly neutralizing antibody bound to natively-glycosylated HIV-1 envelope," Nat Commun. 9(1):1251 (2018) (12 pages).

(56) References Cited

OTHER PUBLICATIONS

Barouch et al., "Immunologic strategies for HIV-1 remission and eradication," available in PMC Jan. 11, 2015, published in final edited form as: Science. 345(6193): 169-174 (2014) (18 pages).
Barouch et al., "Therapeutic efficacy of potent neutralizing HIV-1-specific monoclonal antibodies in SHIV-infected rhesus monkeys," Nature. 503(7475):224-228 (2013) (13 pages).
Behrens et al. "Composition and Antigenic Effects of Individual Glycan Sites of a Trimeric HIV-1 Envelope Glycoprotein," Cell Rep. 14(11):2695-706 (2016) (31 pages).
Brief Communication for European Patent Application No. 14847004.0, dated Jun. 21, 2021 (2 pages).
Chen et al., "Antibody-based candidate therapeutics against HIV-1: implications for virus eradication and vaccine design," Expert Opin Biol Ther. 13(5): 657-671 (2013) (5 pages).
Communication of a notice of opposition for European Patent No. EP3052132, dated May 6, 2021 (36 pages).
Communication pursuant to Rule 63(1) EPC for European Patent Application No. 19807138.3, dated Mar. 1, 2022 (4 pages).
Declaration of Dr. Barouch, European regional phase application EP 14847004.0, dated Oct. 4, 2019 (3 Pages).
Halper-Stromberg et al., "Broadly Neutralizing Antibodies and Viral Inducers Decrease Rebound from HIV-1 Latent Reservoirs in Humanized Mice," Cell. 158(5): 989-999 (2014).
Horwitz et al., "HIV-1 suppression and durable control by combining single broadly neutralizing antibodies and antiretroviral drugs in humanized mice," PNAS. 110(41):Supplementary information. (2013) (7 pages).
Horwitz et al., "HIV-1 suppression and durable control by combining single broadly neutralizing antibodies and antiretroviral drugs in humanized mice," Proc Natl Acad Sci USA. 110(41) 16538-43 (2013) (14 pages).
International Preliminary Report on Patentability for International Patent Application No. PCT/US2019/062203, dated May 25, 2021 (10 pages).
Julg et al., "Broadly neutralizing antibodies targeting the HIV-1 envelope V2 apex confer robust protection against a clade C SHIV challenge," available in PMC Mar. 6, 2018, published in final edited form as: Sci Transl Med. 9(406):eaal1321 (2017) (26 pages).
Katlama et al., "Barriers to a Cure: New concepts in targeting and eradicating HIV-1 reservoirs," available in PMC Jun. 15, 2014, published in final edited form as: Lancet. 381(9883):2109-17 (2013) (19 pages).
Klein et al., "Antibodies in HIV-1 Vaccine Development and Therapy," available in PMC Mar. 31, 2014, published in final edited form as: Science. 341(6151):1199-204 (2013) (17 pages).
Klein et al., "HIV therapy by a combination of broadly neutralizing antibodies in humanized mice," Nature. 492(7427):118-122 (2012) (11 pages).
Kwong et al., "HIV-1 Vaccines Based on Antibody Identification, B Cell Ontogeny, and Epitope Structure," Immunity. 48(5):855-871 (2018).
Lee et al., "A Broadly Neutralizing Antibody Targets the Dynamic HIV Envelope Trimer Apex via a Long, Rigidified, and Anionic beta-Hairpin Structure," Immunity. 46(4):690-702 (2017) (14 pages).
Moyo et al., "Targeting the N332-supersite of the HIV-1 envelope for vaccine design," Expert Opin Ther Targets. 24(6):499-509 (2020) (12 pages).
Sok et al., "Recombinant HIV envelope trimer selects for quaternary-dependent antibodies targeting the trimer apex," Proc Natl Acad Sci U S A. 111(49):17624-9 (2014) (17 pages).
Stephenson et al., "Broadly Neutralizing Antibodies for HIV Eradication," Curr HIV/AIDS Rep. 13(1):31-7 (2016).
Third Party Observation for International Patent Application No. PCT/US2019/062203, dated Mar. 19, 2021 (8 pages).
West et al., "Structural Insights on the Role of Antibodies in HIV-1 Vaccine and Therapy," Cell. 156(4):633-648 (2014).
Zettlitz et al., "IBC's 23rd Annual Antibody Engineering, 10th Annual Antibody Therapeutics International Conferences and the 2012 Annual Meeting of The Antibody Society," MAbs. 5(2):178-201 (2012) (25 pages).
Extended European Search Report for European Patent Application No. 19807138.3, dated Jun. 1, 2022 (10 pages).
Hua et al., "Engineering broadly neutralizing antibodies for HIV prevention and therapy," available in PMC Aug. 1, 2017, published in final edited form as: Adv Drug Deliv Rev. 103:157-173 (2016) (42 pages).

* cited by examiner

FIG. 2A

| Sample ID | Titer in TZM.bl cells (ug/ml) | | | | | | | | | |
|---|---|---|---|---|---|---|---|---|---|---|
| | SC422661.8 | | RHPA4259.7 | | Du172.17 | | BB1012-11.TC21 | | CNE52 | |
| | IC50 | IC80 | IC50 | IC80 | IC50 | IC80 | IC50 | IC80 | IC50 | IC80 |
| Parental | 0.046 | 0.156 | 0.018 | 0.047 | 0.051 | 0.672 | 0.013 | 0.046 | 2.921 | 17.812 |
| MS-22 | 0.055 | 0.189 | 0.031 | 0.133 | 0.092 | 0.193 | 0.023 | 0.107 | 1.949 | 16.364 |
| MS-46 | 0.039 | 0.138 | 0.014 | 0.046 | 0.031 | 0.221 | 0.006 | 0.024 | 2.491 | 20.227 |
| MS-47 | 0.039 | 0.132 | 0.018 | 0.047 | 0.043 | 0.300 | 0.012 | 0.043 | 2.205 | 18.494 |
| MS-48 | 0.029 | 0.100 | 0.013 | 0.034 | 0.020 | 0.165 | 0.009 | 0.033 | 2.813 | 21.935 |
| MS-49 | 0.048 | 0.167 | 0.016 | 0.053 | 0.050 | 0.324 | 0.009 | 0.034 | 2.917 | 24.145 |
| MS-50 | 0.033 | 0.088 | 0.016 | 0.051 | 0.060 | 0.374 | 0.008 | 0.040 | 3.548 | >25 |
| MS-51 | 0.029 | 0.094 | 0.013 | 0.043 | 0.024 | 0.082 | 0.004 | 0.019 | 1.440 | 12.698 |
| MS-52 | 0.045 | 0.181 | 0.022 | 0.070 | 0.057 | 0.360 | 0.007 | 0.031 | 4.116 | >25 |
| MS-53 | 0.082 | 0.825 | 0.066 | 0.457 | 3.364 | >25 | 0.028 | 0.180 | >25 | >25 |
| MS-54 | 0.024 | 0.080 | 0.014 | 0.046 | 0.077 | 0.549 | 0.011 | 0.035 | 3.653 | 22.531 |
| MS-55 | 0.046 | 0.187 | 0.023 | 0.070 | 0.135 | 0.960 | 0.007 | 0.026 | 4.331 | >25 |
| MS-56 | 0.026 | 0.080 | 0.014 | 0.036 | 0.046 | 0.150 | 0.005 | 0.020 | 1.928 | 13.452 |
| MS-57 | 0.012 | 0.033 | 0.006 | 0.016 | 0.009 | 0.041 | 0.002 | 0.009 | 0.787 | 3.688 |
| MS-23 | 0.047 | 0.124 | 0.014 | 0.038 | 0.060 | 0.521 | 0.010 | 0.029 | 2.310 | 24.404 |
| MS-24 | 0.042 | 0.138 | 0.007 | 0.032 | 0.054 | 0.428 | 0.006 | 0.019 | 1.902 | 19.144 |
| MS-25 | 2.133 | 14.719 | 0.082 | 0.368 | 2.457 | 22.090 | 0.033 | 0.158 | >25 | >25 |
| MS-44 | 3.623 | 24.973 | 0.268 | 1.915 | 1.693 | 13.844 | 0.059 | 0.206 | >25 | >25 |
| MS-26 | 0.027 | 0.119 | 0.014 | 0.039 | 0.036 | 0.422 | 0.009 | 0.026 | 2.669 | 18.719 |
| MS-27 | 0.043 | 0.187 | 0.025 | 0.080 | 0.146 | 2.075 | 0.009 | 0.033 | 6.478 | >25 |
| MS-28 | 0.022 | 0.075 | 0.010 | 0.030 | 0.037 | 0.432 | 0.008 | 0.022 | 2.557 | 17.829 |
| MS-29 | 0.034 | 0.110 | 0.009 | 0.043 | 0.041 | 0.293 | 0.012 | 0.033 | 2.321 | >25 |
| MS-30 | 0.041 | 0.120 | 0.012 | 0.035 | 0.049 | 0.366 | 0.008 | 0.029 | 2.165 | 21.250 |
| MS-31 | 0.025 | 0.091 | 0.010 | 0.037 | 0.052 | 0.400 | 0.004 | 0.012 | 2.142 | 21.646 |
| MS-32 | 0.033 | 0.116 | 0.008 | 0.031 | 0.034 | 0.267 | 0.006 | 0.027 | 1.536 | 24.271 |
| MS-45 | 0.017 | 0.065 | 0.007 | 0.025 | 0.028 | 0.150 | 0.004 | 0.017 | 0.948 | 15.260 |
| MS-33 | 0.033 | 0.083 | 0.009 | 0.035 | 0.040 | 0.265 | 0.006 | 0.018 | 1.895 | 16.135 |
| MS-34 | 0.038 | 0.085 | 0.009 | 0.035 | 0.048 | 0.502 | 0.005 | 0.017 | 2.425 | 22.203 |
| MS-35 | 0.041 | 0.095 | 0.008 | 0.037 | 0.062 | 1.716 | 0.005 | 0.018 | 2.657 | >25 |
| MS-36 | 0.039 | 0.121 | 0.011 | 0.037 | 0.038 | 1.096 | 0.007 | 0.023 | 1.836 | 23.830 |
| MS-37 | >25 | >25 | >25 | >25 | >25 | >25 | 9.099 | >25 | >25 | >25 |
| MS-38 | 0.024 | 0.094 | 0.006 | 0.025 | 0.046 | 0.360 | 0.005 | 0.016 | 2.216 | 22.199 |
| MS-39 | 0.039 | 0.133 | 0.009 | 0.032 | 0.046 | 0.226 | 0.007 | 0.026 | 2.166 | 20.486 |
| MS-40 | 0.041 | 0.139 | 0.013 | 0.044 | 0.037 | 0.193 | 0.008 | 0.025 | 1.976 | 18.913 |

FIG. 2B

| Sample ID | Titer in TZM.bl cells (ug/ml) | | | | | | | | |
|---|---|---|---|---|---|---|---|---|---|
| | 0.260.v5.c36 | | 263-8 | | SC05.8C11.2344 | | X1193_c1 | |
| | IC50 | IC80 | IC50 | IC80 | IC50 | IC80 | IC50 | IC80 |
| Parental | 0.051 | 0.143 | 1.037 | 6.043 | 0.019 | 0.071 | 0.039 | 0.132 |
| MS-22 | 0.125 | 0.336 | 0.832 | 4.466 | 0.028 | 0.096 | 0.069 | 0.238 |
| MS-46 | 0.046 | 0.163 | 0.488 | 2.504 | 0.009 | 0.040 | 0.020 | 0.054 |
| MS-47 | 0.034 | 0.128 | 0.588 | 2.945 | 0.016 | 0.048 | 0.022 | 0.059 |
| MS-48 | 0.021 | 0.108 | 0.408 | 3.599 | 0.016 | 0.063 | 0.029 | 0.107 |
| MS-49 | 0.050 | 0.187 | 0.655 | 3.388 | 0.014 | 0.054 | 0.029 | 0.130 |
| MS-50 | 0.080 | 0.221 | 0.697 | 6.102 | 0.021 | 0.061 | 0.027 | 0.116 |
| MS-51 | 0.048 | 0.146 | 0.120 | 0.868 | 0.015 | 0.046 | 0.020 | 0.085 |
| MS-52 | 0.052 | 0.159 | 0.462 | 3.390 | 0.022 | 0.060 | 0.032 | 0.135 |
| MS-53 | 0.130 | 1.039 | >25 | >25 | 0.462 | 2.506 | 0.055 | 0.369 |
| MS-54 | 0.050 | 0.172 | 0.671 | 3.559 | 0.028 | 0.080 | 0.035 | 0.126 |
| MS-55 | 0.055 | 0.190 | 1.029 | 6.303 | 0.023 | 0.080 | 0.032 | 0.110 |
| MS-56 | 0.022 | 0.078 | 0.742 | 3.795 | 0.016 | 0.044 | 0.019 | 0.068 |
| MS-57 | 0.008 | 0.022 | 0.283 | 1.950 | 0.006 | 0.017 | 0.006 | 0.018 |
| MS-23 | 0.056 | 0.153 | 0.930 | 8.902 | 0.016 | 0.059 | 0.030 | 0.113 |
| MS-24 | 0.057 | 0.150 | 0.613 | 5.659 | 0.019 | 0.068 | 0.026 | 0.096 |
| MS-25 | 1.239 | 6.165 | >25 | >25 | 0.172 | 0.796 | 0.108 | 0.409 |
| MS-44 | 4.383 | 24.098 | >25 | >25 | 0.088 | 0.608 | 0.176 | 0.848 |
| MS-26 | 0.040 | 0.143 | 0.639 | 3.806 | 0.020 | 0.075 | 0.024 | 0.086 |
| MS-27 | 0.078 | 0.276 | 0.697 | 7.013 | 0.036 | 0.128 | 0.035 | 0.161 |
| MS-28 | 0.031 | 0.112 | 0.516 | 3.126 | 0.020 | 0.072 | 0.022 | 0.079 |
| MS-29 | 0.040 | 0.191 | 0.993 | 11.946 | 0.021 | 0.071 | 0.024 | 0.087 |
| MS-30 | 0.053 | 0.181 | 0.818 | 4.985 | 0.023 | 0.082 | 0.035 | 0.124 |
| MS-31 | 0.053 | 0.178 | 0.537 | 6.791 | 0.020 | 0.068 | 0.017 | 0.065 |
| MS-32 | 0.057 | 0.189 | 0.478 | 2.478 | 0.016 | 0.057 | 0.017 | 0.063 |
| MS-45 | 0.040 | 0.133 | 0.127 | 0.857 | 0.004 | 0.017 | 0.018 | 0.055 |
| MS-33 | 0.032 | 0.114 | 0.540 | 3.012 | 0.015 | 0.053 | 0.027 | 0.076 |
| MS-34 | 0.036 | 0.128 | 0.184 | 0.944 | 0.014 | 0.051 | 0.025 | 0.090 |
| MS-35 | 0.040 | 0.182 | 0.361 | 1.750 | 0.019 | 0.066 | 0.026 | 0.086 |
| MS-36 | 0.047 | 0.131 | 0.833 | 5.104 | 0.014 | 0.050 | 0.021 | 0.077 |
| MS-37 | >25 | >25 | >25 | >25 | 22.089 | >25 | >25 | >25 |
| MS-38 | 0.043 | 0.149 | 0.629 | 6.038 | 0.014 | 0.050 | 0.026 | 0.100 |
| MS-39 | 0.049 | 0.171 | 0.686 | 5.599 | 0.022 | 0.074 | 0.039 | 0.128 |
| MS-40 | 0.054 | 0.180 | 1.000 | 5.665 | 0.014 | 0.049 | 0.038 | 0.120 |
| MS-41 | | | | | | | | |

FIG. 2C

| Sample ID | Titer in TZM.bl cells (ug/ml) | | | | | | | |
|---|---|---|---|---|---|---|---|---|
| | Ce1176_A3 | | AC10.0.29 | | 6952.v1.c20 | | MuLV | |
| | IC50 | IC80 | IC50 | IC80 | IC50 | IC80 | IC50 | IC80 |
| Parental | 0.020 | 0.076 | 0.008 | 0.023 | 0.054 | 0.342 | >25 | >25 |
| MS-22 | 0.038 | 0.143 | 0.010 | 0.034 | 0.077 | 0.341 | >25 | >25 |
| MS-46 | 0.019 | 0.069 | 0.005 | 0.017 | 0.036 | 0.159 | >25 | >25 |
| MS-47 | 0.017 | 0.061 | 0.006 | 0.017 | 0.036 | 0.159 | >25 | >25 |
| MS-48 | 0.009 | 0.036 | 0.005 | 0.014 | 0.021 | 0.147 | >25 | >25 |
| MS-49 | 0.016 | 0.047 | 0.006 | 0.022 | 0.030 | 0.131 | >25 | >25 |
| MS-50 | 0.021 | 0.079 | 0.007 | 0.020 | 0.039 | 0.175 | >25 | >25 |
| MS-51 | 0.007 | 0.028 | 0.004 | 0.010 | 0.013 | 0.044 | >25 | >25 |
| MS-52 | 0.017 | 0.067 | 0.005 | 0.016 | 0.023 | 0.105 | >25 | >25 |
| MS-53 | 0.034 | 0.156 | 0.008 | 0.026 | 0.348 | 2.966 | >25 | >25 |
| MS-54 | 0.023 | 0.107 | 0.008 | 0.018 | 0.037 | 0.229 | >25 | >25 |
| MS-55 | 0.019 | 0.086 | 0.008 | 0.020 | 0.074 | 0.457 | >25 | >25 |
| MS-56 | 0.009 | 0.031 | 0.003 | 0.018 | 0.028 | 0.120 | >25 | >25 |
| MS-57 | 0.003 | 0.011 | 0.009 | 0.010 | 0.005 | 0.035 | >25 | >25 |
| MS-23 | 0.080 | 0.371 | 0.009 | 0.026 | 0.022 | 0.143 | >25 | >25 |
| MS-24 | 0.020 | 0.091 | 0.009 | 0.025 | 0.022 | 0.144 | >25 | >25 |
| MS-25 | 0.137 | 0.604 | 0.029 | 0.074 | 1.730 | 14.882 | >25 | >25 |
| MS-44 | 0.438 | 1.937 | 0.022 | 0.074 | 0.739 | 5.831 | >25 | >25 |
| MS-26 | 0.016 | 0.058 | 0.008 | 0.020 | 0.025 | 0.169 | >25 | >25 |
| MS-27 | 0.036 | 0.130 | 0.013 | 0.030 | 0.099 | 0.462 | >25 | >25 |
| MS-28 | 0.009 | 0.046 | 0.007 | 0.023 | 0.031 | 0.144 | >25 | >25 |
| MS-29 | 0.023 | 0.081 | 0.008 | 0.021 | 0.044 | 0.218 | >25 | >25 |
| MS-30 | 0.023 | 0.080 | 0.007 | 0.017 | 0.025 | 0.122 | >25 | >25 |
| MS-31 | 0.016 | 0.071 | 0.006 | 0.018 | 0.023 | 0.116 | >25 | >25 |
| MS-32 | 0.015 | 0.052 | 0.005 | 0.018 | 0.020 | 0.154 | >25 | >25 |
| MS-45 | 0.012 | 0.052 | 0.004 | 0.014 | 0.012 | 0.043 | >25 | >25 |
| MS-33 | 0.011 | 0.040 | 0.005 | 0.021 | 0.013 | 0.094 | >25 | >25 |
| MS-34 | 0.012 | 0.059 | 0.007 | 0.024 | 0.021 | 0.163 | >25 | >25 |
| MS-35 | 0.012 | 0.063 | 0.005 | 0.020 | 0.024 | 0.257 | >25 | >25 |
| MS-36 | 0.013 | 0.072 | 0.005 | 0.019 | 0.016 | 0.159 | >25 | >25 |
| MS-37 | 0.015 | >25 | 0.244 | 0.853 | >25 | >25 | >25 | >25 |
| MS-38 | >25 | 0.033 | 0.005 | 0.021 | 0.018 | 0.125 | >25 | >25 |
| MS-39 | 0.009 | 0.054 | 0.002 | 0.011 | 0.023 | 0.164 | >25 | >25 |
| MS-40 | 0.015 | 0.077 | 0.004 | 0.015 | 0.016 | 0.158 | >25 | >25 |
| MS-41 | 0.023 | | | | | | | |

FIG. 5

| | % Main | % Dimer | % Oligomer | DSF (WSS) | GuHCl Inflection Point (M) | pH 3.3 %HMW | PEG Solubility % (ave) | Lambda LC Mutations | HC Mutations |
|---|---|---|---|---|---|---|---|---|---|
| MS-439 | 83.2 | 2.4 | 0.39 | 6.2 | 2.2 | 18.93 | 0.130 | LmdV:E17Q LmdV:H46Q | HV:R46Q |
| MS-400 | 86.1 | 1.6 | 0.34 | 9.2 | 2.3 | 11.55 | 0.130 | LmdV:H46Q LmdV:P82G | HV:R46Q |
| MS-401 | 87.8 | 1.8 | 0.33 | 7.1 | 2.3 | 22.68 | 0.134 | LmdV:H46Q LmdV:T144K | HV:R46Q |
| MS-402 | 86.1 | 1.5 | 0.2 | 6.6 | 2.5 | 24.01 | 0.133 | LmdV:H46Q | HV:R46Q HV:S47P |
| MS-403 | 85.3 | 1.7 | 0.24 | 6.8 | 2.3 | 12.61 | 0.132 | LmdV:H46Q | HV:R46Q HV:Y94S |
| MS-404 | 85.8 | 1.7 | 0.23 | 6.3 | 2.4 | 16.725 | 0.132 | LmdV:H46Q | HV:R46Q HV:K103V |
| MS-405 | 87.8 | 1.7 | 0.23 | 6.4 | 2.4 | 13.86 | 0.137 | LmdV:E17Q LmdV:H46Q | HV:R46Q HV:S47P |
| MS-406 | 84.8 | 2.0 | 0.28 | 6.7 | 2.4 | 11.05 | 0.133 | LmdV:E17Q LmdV:H46Q | HV:R46Q HV:K103V |
| MS-407 | 87.2 | 1.6 | 0.31 | 11.2 | 2.4 | 11.94 | 0.135 | LmdV:H46Q LmdV:P82G LmdV:T144K | HV:R46Q |
| MS-408 | 86.1 | 1.6 | 0.34 | 13.1 | 2.4 | 6.635 | 0.135 | LmdV:H46Q LmdV:P82G | HV:R46Q HV:Y94S |
| MS-409 | 85.7 | 2.0 | 0.3 | 7.7 | 2.2 | 11.84 | 0.134 | LmdV:H46Q | HV:R46Q HV:Y94S |
| MS-410 | 87.7 | 1.8 | 0.28 | 16.9 | 2.2 | 10.66 | 0.131 | LmdV:H46Q LmdV:P82G LmdV:T144K | HV:R46Q HV:S47P HV:K103V |
| MS-411 | 87.7 | 2.0 | 0.28 | 10.6 | 2.4 | 8.075 | 0.135 | LmdV:H46Q LmdV:P82G LmdV:T144K | HV:R46Q HV:S47P HV:K103V |
| MS-412 | 86.6 | 1.4 | 0.31 | 10.1 | 2.5 | 6.185 | 0.132 | LmdV:H46Q LmdV:P82G LmdV:T144K | HV:R46Q HV:Y94S HV:K103V |
| MS-413 | 86.3 | 1.4 | 0.41 | 12.7 | 2.3 | 4.2 | 0.132 | LmdV:E17Q LmdV:H46Q LmdV:P82G LmdV:T144K | HV:R46Q HV:Y94S HV:K103V |
| MS-414 | 86.5 | 1.2 | 0.26 | 10.3 | 2.5 | 3.44 | 0.136 | LmdV:H46Q LmdV:P82G | HV:R46Q HV:S47P HV:Y94S HV:N141Q |
| MS-437 | 88.5 | 1.3 | 0.19 | 5.3 | 2.4 | 10.725 | 0.138 | LmdV:H46Q | HV:R46Q HV:N141Q |
| MS-438 | 87.2 | 1.9 | 0.34 | 6.1 | 2.4 | 10.835 | 0.128 | LmdV:H46Q | HV:R46Q HV:Y94S HV:N141Q |
| MS-439 | 86.1 | 1.4 | 0.29 | 5.3 | 2.3 | 14.655 | 0.175 | LmdV:H46Q LmdV:P82G LmdV:T144K | HV:R46Q HV:Y94S HV:N141Q |
| MS-440 | 86.1 | 1.6 | 0.31 | 5.5 | 2.3 | 23.71 | 0.173 | LmdV:H46Q LmdV:T144K | HV:R46Q HV:Y94S HV:N141Q |
| MS-441 | 85.5 | 0.8 | 0.22 | 9.5 | 2.5 | 23.58 | 0.144 | LmdV:H46Q LmdV:P82G | HV:R46Q HV:Y94S HV:N141Q |
| MS-442 | 87.3 | 1.8 | 0.34 | 10.7 | 2.5 | 10.34 | 0.130 | LmdV:H46Q LmdV:P82G | HV:R46Q HV:Y94S HV:N141Q |
| MS-443 | 85.3 | 1.4 | 0.3 | 12.7 | 2.5 | 9.595 | 0.133 | LmdV:H46Q LmdV:P82G | HV:R46Q HV:Y94S HV:N141Q |
| MS-444 | 88.3 | 1.5 | 0.31 | 14.3 | 2.2 | 5.13 | 0.136 | LmdV:E17Q LmdV:H46Q LmdV:P82G | HV:R46Q HV:Y94S HV:K103V HV:N141Q |
| MS-445 | 88.5 | 1.2 | 0.3 | 11.5 | 2.5 | 9.75 | 0.135 | LmdV:H46Q LmdV:P82G | HV:R46Q HV:Y94S HV:K103V HV:N141Q |
| MS-42 | 83.6 | 2.4 | 0.37 | 5.7 | 2.1 | 8.44 | 0.132 | | |

ANTIBODY THERAPIES FOR HUMAN IMMUNODEFICIENCY VIRUS (HIV)

SEQUENCE LISTING

The instant application contains a Sequence Listing which has been submitted electronically in ASCII format and is hereby incorporated by reference in its entirety. Said ASCII copy, created on May 20, 2019, is named "01948-259WO2—Sequence Listing 05.20.2019" and is 1,056,756 bytes in size.

BACKGROUND OF THE INVENTION

Acquired immunodeficiency syndrome (AIDS) is a chronic, potentially life-threatening condition caused by the human immunodeficiency virus (HIV). In 2010, there were approximately 1.8 million deaths attributed to AIDS, and nearly 30 million people with AIDS have died worldwide since the epidemic began (Centers for Disease Control and Prevention. *HIV Surveillance Report.* Vol. 23, 2011).

Even though current therapies, such as antiretroviral therapies (ARTs), have reduced AIDS-related deaths in many developed nations, HIV infections continue to be a serious health issue. In 2011, the estimated number of diagnoses of HIV infection was 49,273 in the United States alone. Worldwide, about 34.2 million people are living with HIV, with about 2.5 million new cases of HIV infection having been diagnosed in 2011 (Centers for Disease Control and Prevention. *HIV Surveillance Report.* Vol. 23, 2011).

Thus, there remains an unmet need in the field for therapies capable of treating an HIV-infected individual or blocking an HIV infection in a subject at risk of HIV transmission.

SUMMARY OF THE INVENTION

Featured herein are antibody variants (e.g., PGT121 variant antibodies) or antigen-binding fragments thereof that retain the ability of the native antibody to inactivate or neutralize viruses (e.g., HIV-1), while showing significant improvements in biophysical properties. Also featured are methods of treating or blocking human immunodeficiency virus (HIV) infection by administration of these antibodies or antigen-binding fragments thereof.

A first aspect features a PGT121 variant antibody or antigen-binding fragment thereof that has: (a) a heavy chain variable domain having a sequence with at least 90% (e.g., at least 91%, at least 92%, at least 93%, at least 94%, at least 95%, at least 96%, at least 97%, at least 98%, at least 99%, or 100%) sequence identity to SEQ ID NO: 1393, wherein the heavy chain variable domain sequence has at least one (e.g., at least one, at least two, at least three, at least four, at least five, at least six, at least seven, at least eight, at least nine, or more) of the following mutations: A27G, D31E, D31S, R39Q, S40P, D56E, D56S, N68T, V78F, S81K, V83S, A84S, K92V, and N124Q and/or (b) a light chain variable domain having a sequence with at least 90% (e.g., at least 91%, at least 92%, at least 93%, at least 94%, at least 95%, at least 96%, at least 97%, at least 98%, at least 99%, or 100%) sequence identity to SEQ ID NO: 1394, wherein the light chain variable domain sequence has at least one (e.g., at least one, at least two, at least three, at least four, at least five, at least six, at least seven, at least eight, at least nine, or more) of the following mutations: S1P, D2S, E9Q, H30Q, S37V, P58S, P61G, S72G, D87E, and T101K. In some embodiments of the above aspect, the antibody or antigen-binding fragment thereof has at least one (e.g., at least one, at least two, at least three, at least four, at least five, at least six, at least seven, at least eight, at least nine, or more) of the mutations (e.g., A27G, D31E, D31S, R39Q, S40P, D56E, D56S, N68T, V78F, S81K, V83S, A84S, K92V, N124Q, and R39Q) in the heavy chain variable domain, and no mutation in the light chain variable domain. In other embodiments, the antibody or antigen-binding fragment thereof has at least one (e.g., at least one, at least two, at least three, at least four, at least five, at least six, at least seven, at least eight, at least nine, or more) of the mutations (e.g., S1P, D2S, E9Q, H30Q, S37V, P58S, P61G, S72G, D87E, and T101K) in the light chain variable domain, and no mutation in the heavy chain variable domain. In some embodiments of the above aspect, the heavy chain variable domain of the antibody or antigen-binding fragment thereof has at least one (e.g., at least one, at least two, at least three, at least four, at least five, at least six, at least seven, at least eight, at least nine, or more) amino acid modification(s) (e.g., an insertion, deletion, or substitution) in the framework region relative to the amino acid sequence of SEQ ID NO: 1393. Additionally, or alternatively, the heavy chain variable domain of the antibody or antigen-binding fragment thereof may have at least one (e.g., at least one, at least two, at least three, at least four, at least five, at least six, at least seven, at least eight, at least nine, or more) amino acid modification(s) (e.g., an insertion, deletion, or substitution) in the heavy chain (HC) complementarity determining region (CDR) (such as, HC-CDR1, HC-CDR2, and/or HC-CDR3) relative to the amino acid sequence of SEQ ID NO: 1393. In other embodiments, the light chain variable domain of the antibody or antigen-binding fragment thereof has at least one (e.g., at least one, at least two, at least three, at least four, at least five, at least six, at least seven, at least eight, at least nine, or more) amino acid modification(s) (e.g., an insertion, deletion, or substitution) in the framework region relative to the amino acid sequence of SEQ ID NO: 1394. Additionally, or alternatively, the light chain variable domain of the antibody or antigen-binding fragment thereof may have at least one (e.g., at least one, at least two, at least three, at least four, at least five, at least six, at least seven, at least eight, at least nine, or more) amino acid modification(s) (e.g., an insertion, deletion, or substitution) in the light chain (LC) CDR (such as, LC-CDR1, LC-CDR2, and/or LC-CDR3) relative to the amino acid sequence of SEQ ID NO: 1394.

The antibody antigen-binding fragment thereof may also include an Fc domain. The Fc domain of the antibody or antigen-binding fragment thereof may have the sequence of SEQ ID NO: 1401, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1401. In other instances, the Fc domain of the antibody or antigen-binding fragment thereof described herein may have the sequence of SEQ ID NO: 1402, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1402. In some embodiments, the Fc domain of the antibody or antigen-binding fragment thereof includes a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1401, and a M87L and/or a N93S mutation. In additional embodiments, the Fc domain of the antibody or antigen-binding fragment thereof described herein further includes the sequence of SEQ ID NO: 1403, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1403. In some instances, the Fc domain of the antibody or antigen-binding fragments thereof described herein has: (i) the sequence of SEQ ID NO: 1404, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1404; or (ii) the sequence of SEQ ID NO: 1405, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1405.

In some embodiments, the antibody or antigen-binding fragment thereof further includes an IG domain with the sequence of SEQ ID NO: 1406, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1406; and/or a Hinge region with the sequence of SEQ ID NO: 1407, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1407.

In some embodiments of the above aspect, the antibody or antigen-binding fragment thereof is an N332 glycan-dependent antibody.

In particular embodiments, the featured antibody or antigen-binding fragment thereof has:
(a) MS-43:
  (i) a heavy chain (HC) complementarity determining region (CDR) HC-CDR1 with the amino acid sequence of SEQ ID NO: 12, a HC-CDR2 with the amino acid sequence of SEQ ID NO: 14, a HC-CDR3 with the amino acid sequence of SEQ ID NO: 16, a light chain (LC)-CDR1 with the amino acid sequence of SEQ ID NO: 4, a LC-CDR2 with the amino acid sequence of SEQ ID NO: 6, and a LC-CDR3 with the amino acid sequence of SEQ ID NO: 8; and/or (ii) a heavy chain variable domain having amino acids 20-481 of SEQ ID NO: 10, and a light chain variable domain having amino acids 20-230 of SEQ ID NO: 2;
(b) MS-22:
  (i) a HC-CDR1 with the amino acid sequence of SEQ ID NO: 28, a HC-CDR2 with the amino acid sequence of SEQ ID NO: 30, a HC-CDR3 with the amino acid sequence of SEQ ID NO: 32, a LC-CDR1 with the amino acid sequence of SEQ ID NO: 20, a LC-CDR2 with the amino acid sequence of SEQ ID NO: 22, and a LC-CDR3 with the amino acid sequence of SEQ ID NO: 24; and/or (ii) a heavy chain variable domain having amino acids 20-481 of SEQ ID NO: 26, and a light chain variable domain having amino acids 20-230 of SEQ ID NO: 18;
(c) MS-46:
  (i) a HC-CDR1 with the amino acid sequence of SEQ ID NO: 44, a HC-CDR2 with the amino acid sequence of SEQ ID NO: 46, a HC-CDR3 with the amino acid sequence of SEQ ID NO: 48, a LC-CDR1 with the amino acid sequence of SEQ ID NO: 36, a LC-CDR2 with the amino acid sequence of SEQ ID NO: 38, and a LC-CDR3 with the amino acid sequence of SEQ ID NO: 40; and/or (ii) a heavy chain variable domain having amino acids 20-481 of SEQ ID NO: 42, and a light chain variable domain having amino acids 20-230 of SEQ ID NO: 34;
(d) MS-47:
  (i) a HC-CDR1 with the amino acid sequence of SEQ ID NO: 60, a HC-CDR2 with the amino acid sequence of SEQ ID NO: 62, a HC-CDR3 with the amino acid sequence of SEQ ID NO: 64, a LC-CDR1 with the amino acid sequence of SEQ ID NO: 52, a LC-CDR2 with the amino acid sequence of SEQ ID NO: 54, and a LC-CDR3 with the amino acid sequence of SEQ ID NO: 56; and/or (ii) a heavy chain variable domain having amino acids 20-481 of SEQ ID NO: 58, and a light chain variable domain having amino acids 20-230 of SEQ ID NO: 50;
(e) MS-48:
  (i) a HC-CDR1 with the amino acid sequence of SEQ ID NO: 76, a HC-CDR2 with the amino acid sequence of SEQ ID NO: 78, a HC-CDR3 with the amino acid sequence of SEQ ID NO: 80, a LC-CDR1 with the amino acid sequence of SEQ ID NO: 68, a LC-CDR2 with the amino acid sequence of SEQ ID NO: 70, and a LC-CDR3 with the amino acid sequence of SEQ ID NO: 72; and/or (ii) a heavy chain variable domain having amino acids 20-481 of SEQ ID NO: 74, and a light chain variable domain having amino acids 20-230 of SEQ ID NO: 66;
(f) MS-49:
  (i) a HC-CDR1 with the amino acid sequence of SEQ ID NO: 92, a HC-CDR2 with the amino acid sequence of SEQ ID NO: 94, a HC-CDR3 with the amino acid sequence of SEQ ID NO: 96, a LC-CDR1 with the amino acid sequence of SEQ ID NO: 84, a LC-CDR2 with the amino acid sequence of SEQ ID NO: 86, and a LC-CDR3 with the amino acid sequence of SEQ ID NO: 88; and/or (ii) a heavy chain variable domain having amino acids 20-481 SEQ ID NO: 90, and a light chain variable domain having amino acids 20-230 of SEQ ID NO: 82;
(g) MS-50:
  (i) a HC-CDR1 with the amino acid sequence of SEQ ID NO: 108, a HC-CDR2 with the amino acid sequence of SEQ ID NO: 110, a HC-CDR3 with the amino acid sequence of SEQ ID NO: 112, a LC-CDR1 with the amino acid sequence of SEQ ID NO: 100, a LC-CDR2 with the amino acid sequence of SEQ ID NO: 102, and a LC-CDR3 with the amino acid sequence of SEQ ID NO: 104; and/or (ii) a heavy chain variable domain having amino acids 20-481 of SEQ ID NO: 106, and alight chain variable domain having amino acids 20-230 of SEQ ID NO: 98;
(h) MS-51:
  (i) a HC-CDR1 with the amino acid sequence of SEQ ID NO: 124, a HC-CDR2 with the amino acid sequence of SEQ ID NO: 126, a HC-CDR3 with the amino acid sequence of SEQ ID NO: 128, a LC-CDR1 with the amino acid sequence of SEQ ID NO: 116, a LC-CDR2 with the amino acid sequence of SEQ ID NO: 118, and a LC-CDR3 with the amino acid sequence of SEQ ID NO: 120; and/or (ii) a heavy chain variable domain having amino acids 20-481 of SEQ ID NO: 122, and a light chain variable domain having amino acids 20-230 of SEQ ID NO: 114;

(i) MS-52:
(i) a HC-CDR1 with the amino acid sequence of SEQ ID NO: 140, a HC-CDR2 with the amino acid sequence of SEQ ID NO: 142, a HC-CDR3 with the amino acid sequence of SEQ ID NO: 144, a LC-CDR1 with the amino acid sequence of SEQ ID NO: 132, a LC-CDR2 with the amino acid sequence of SEQ ID NO: 134, and a LC-CDR3 with the amino acid sequence of SEQ ID NO: 136; and/or (ii) a heavy chain variable domain having amino acids 20-481 of SEQ ID NO: 138, and a light chain variable domain having amino acids 20-230 of SEQ ID NO: 130;

(j) MS-53:
(i) a HC-CDR1 with the amino acid sequence of SEQ ID NO: 156, a HC-CDR2 with the amino acid sequence of SEQ ID NO: 158, a HC-CDR3 with the amino acid sequence of SEQ ID NO: 160, a LC-CDR1 with the amino acid sequence of SEQ ID NO: 148, a LC-CDR2 with the amino acid sequence of SEQ ID NO: 150, and a LC-CDR3 with the amino acid sequence of SEQ ID NO: 152; and/or (ii) a heavy chain variable domain having amino acids 20-481 of SEQ ID NO: 154, and alight chain variable domain having amino acids 20-230 of SEQ ID NO: 146;

(k) MS-54:
(i) a HC-CDR1 with the amino acid sequence of SEQ ID NO: 172, a HC-CDR2 with the amino acid sequence of SEQ ID NO: 174, a HC-CDR3 with the amino acid sequence of SEQ ID NO: 176, a LC-CDR1 with the amino acid sequence of SEQ ID NO: 164, a LC-CDR2 with the amino acid sequence of SEQ ID NO: 166, and a LC-CDR3 with the amino acid sequence of SEQ ID NO: 168; and/or (ii) a heavy chain variable domain having amino acids 20-481 of SEQ ID NO: 170, and alight chain variable domain having amino acids 20-230 of SEQ ID NO: 162;

(l) MS-55:
(i) a HC-CDR1 with the amino acid sequence of SEQ ID NO: 188, a HC-CDR2 with the amino acid sequence of SEQ ID NO: 190, a HC-CDR3 with the amino acid sequence of SEQ ID NO: 192, a LC-CDR1 with the amino acid sequence of SEQ ID NO: 180, a LC-CDR2 with the amino acid sequence of SEQ ID NO: 182, and a LC-CDR3 with the amino acid sequence of SEQ ID NO: 184; and/or (ii) a heavy chain variable domain having amino acids 20-481 of SEQ ID NO: 186, and alight chain variable domain having amino acids 20-230 of SEQ ID NO: 178;

(m) MS-56:
(i) a HC-CDR1 with the amino acid sequence of SEQ ID NO: 204, a HC-CDR2 with the amino acid sequence of SEQ ID NO: 206, a HC-CDR3 with the amino acid sequence of SEQ ID NO: 208, a LC-CDR1 with the amino acid sequence of SEQ ID NO: 196, a LC-CDR2 with the amino acid sequence of SEQ ID NO: 198, and a LC-CDR3 with the amino acid sequence of SEQ ID NO: 200; and/or (ii) a heavy chain variable domain having amino acids 20-481 of SEQ ID NO: 202, and a light chain variable domain having amino acids 20-230 of SEQ ID NO: 194;

(n) MS-57:
(i) a HC-CDR1 with the amino acid sequence of SEQ ID NO: 220, a HC-CDR2 with the amino acid sequence of SEQ ID NO: 222, a HC-CDR3 with the amino acid sequence of SEQ ID NO: 224, a LC-CDR1 with the amino acid sequence of SEQ ID NO: 212, a LC-CDR2 with the amino acid sequence of SEQ ID NO: 214, and a LC-CDR3 with the amino acid sequence of SEQ ID NO: 216; and/or (ii) a heavy chain variable domain having amino acids 20-481 of SEQ ID NO: 218, and a light chain variable domain having amino acids 20-230 of SEQ ID NO: 210;

(o) MS-23:
(i) a HC-CDR1 with the amino acid sequence of SEQ ID NO: 236, a HC-CDR2 with the amino acid sequence of SEQ ID NO: 238, a HC-CDR3 with the amino acid sequence of SEQ ID NO: 240, a LC-CDR1 with the amino acid sequence of SEQ ID NO: 228, a LC-CDR2 with the amino acid sequence of SEQ ID NO: 230, and a LC-CDR3 with the amino acid sequence of SEQ ID NO: 232; and/or (ii) a heavy chain variable domain having amino acids 20-481 of SEQ ID NO: 234, and a light chain variable domain having amino acids 20-230 of SEQ ID NO: 226;

(p) MS-24:
(i) a HC-CDR1 with the amino acid sequence of SEQ ID NO: 252, a HC-CDR2 with the amino acid sequence of SEQ ID NO: 254, a HC-CDR3 with the amino acid sequence of SEQ ID NO: 256, a LC-CDR1 with the amino acid sequence of SEQ ID NO: 244, a LC-CDR2 with the amino acid sequence of SEQ ID NO: 246, and a LC-CDR3 with the amino acid sequence of SEQ ID NO: 248; and/or (ii) a heavy chain variable domain having amino acids 20-481 of SEQ ID NO: 250, and a light chain variable domain having amino acids 20-230 of SEQ ID NO: 242;

(q) MS-25:
(i) a HC-CDR1 with the amino acid sequence of SEQ ID NO: 268, a HC-CDR2 with the amino acid sequence of SEQ ID NO: 270, a HC-CDR3 with the amino acid sequence of SEQ ID NO: 272, a LC-CDR1 with the amino acid sequence of SEQ ID NO: 260, a LC-CDR2 with the amino acid sequence of SEQ ID NO: 262, and a LC-CDR3 with the amino acid sequence of SEQ ID NO: 264; and/or (ii) a heavy chain variable domain having amino acids 20-481 of SEQ ID NO: 266, and alight chain variable domain having amino acids 20-230 of SEQ ID NO: 258;

(r) MS-44:
(i) a HC-CDR1 with the amino acid sequence of SEQ ID NO: 284, a HC-CDR2 with the amino acid sequence of SEQ ID NO: 286, a HC-CDR3 with the amino acid sequence of SEQ ID NO: 288, a LC-CDR1 with the amino acid sequence of SEQ ID NO: 276, a LC-CDR2 with the amino acid sequence of SEQ ID NO: 278, and a LC-CDR3 with the amino acid sequence of SEQ ID NO: 280; and/or (ii) a heavy chain variable domain having amino acids 20-481 of SEQ ID NO: 282, and a light chain variable domain having amino acids 20-230 of SEQ ID NO: 274;

(s) MS-26:
(i) a HC-CDR1 with the amino acid sequence of SEQ ID NO: 300, a HC-CDR2 with the amino acid sequence of SEQ ID NO: 302, a HC-CDR3 with the amino acid sequence of SEQ ID NO: 304, a LC-CDR1 with the amino acid sequence of SEQ ID NO: 292, a LC-CDR2 with the amino acid sequence of SEQ ID NO: 294, and a LC-CDR3 with the amino acid sequence of SEQ ID NO: 296; and/or (ii) a heavy chain variable domain having amino acids 20-481 of SEQ ID NO: 298, and a light chain variable domain having amino acids 20-230 of SEQ ID NO: 290;

(t) MS-27:
(i) a HC-CDR1 with the amino acid sequence of SEQ ID NO: 316, a HC-CDR2 with the amino acid sequence of SEQ ID NO: 318, a HC-CDR3 with the amino acid sequence of SEQ ID NO: 320, a LC-CDR1 with the amino acid sequence of SEQ ID NO: 308, a LC-CDR2 with the amino acid sequence of SEQ ID NO: 310, and a LC-CDR3 with the amino acid sequence of SEQ ID NO: 312; and/or (ii) a heavy chain variable domain having amino acids 20-481 of SEQ ID NO: 314, and alight chain variable domain having amino acids 20-230 of SEQ ID NO: 306;

(u) MS-28:
(i) a HC-CDR1 with the amino acid sequence of SEQ ID NO: 332, a HC-CDR2 with the amino acid sequence of SEQ ID NO: 334, a HC-CDR3 with the amino acid sequence of SEQ ID NO: 336, a LC-CDR1 with the amino acid sequence of SEQ ID NO: 324, a LC-CDR2 with the amino acid sequence of SEQ ID NO: 326, and a LC-CDR3 with the amino acid sequence of SEQ ID NO: 328; and/or (ii) a heavy chain variable domain having amino acids 20-481 of SEQ ID NO: 330, and a light chain variable domain having amino acids 20-230 of SEQ ID NO: 322;

(v) MS-29:
(i) a HC-CDR1 with the amino acid sequence of SEQ ID NO: 348, a HC-CDR2 with the amino acid sequence of SEQ ID NO: 350, a HC-CDR3 with the amino acid sequence of SEQ ID NO: 352, a LC-CDR1 with the amino acid sequence of SEQ ID NO: 340, a LC-CDR2 with the amino acid sequence of SEQ ID NO: 342, and a LC-CDR3 with the amino acid sequence of SEQ ID NO: 344; and/or (ii) a heavy chain variable domain having amino acids 20-481 of SEQ ID NO: 346, and a light chain variable domain having amino acids 20-230 of SEQ ID NO: 338;

(w) MS-30:
(i) a HC-CDR1 with the amino acid sequence of SEQ ID NO: 364, a HC-CDR2 with the amino acid sequence of SEQ ID NO: 366, a HC-CDR3 with the amino acid sequence of SEQ ID NO: 368, a LC-CDR1 with the amino acid sequence of SEQ ID NO: 356, a LC-CDR2 with the amino acid sequence of SEQ ID NO: 358, and a LC-CDR3 with the amino acid sequence of SEQ ID NO: 360; and/or (ii) a heavy chain variable domain having amino acids 20-481 of SEQ ID NO: 362, and a light chain variable domain having amino acids 20-230 of SEQ ID NO: 354;

(x) MS-31:
(i) a HC-CDR1 with the amino acid sequence of SEQ ID NO: 380, a HC-CDR2 with the amino acid sequence of SEQ ID NO: 382, a HC-CDR3 with the amino acid sequence of SEQ ID NO: 384, a LC-CDR1 with the amino acid sequence of SEQ ID NO: 372, a LC-CDR2 with the amino acid sequence of SEQ ID NO: 374, and a LC-CDR3 with the amino acid sequence of SEQ ID NO: 376; and/or (ii) a heavy chain variable domain having amino acids 20-481 of SEQ ID NO: 378, and a light chain variable domain having amino acids 20-230 of SEQ ID NO: 370;

(y) MS-32:
(i) a HC-CDR1 with the amino acid sequence of SEQ ID NO: 396, a HC-CDR2 with the amino acid sequence of SEQ ID NO: 398, a HC-CDR3 with the amino acid sequence of SEQ ID NO: 400, a LC-CDR1 with the amino acid sequence of SEQ ID NO: 388, a LC-CDR2 with the amino acid sequence of SEQ ID NO: 390, and a LC-CDR3 with the amino acid sequence of SEQ ID NO: 392; and/or (ii) a heavy chain variable domain having amino acids 20-481 of SEQ ID NO: 394, and a light chain variable domain having amino acids 20-230 of SEQ ID NO: 386;

(z) MS-45:
(i) a HC-CDR1 with the amino acid sequence of SEQ ID NO: 412, a HC-CDR2 with the amino acid sequence of SEQ ID NO: 414, a HC-CDR3 with the amino acid sequence of SEQ ID NO: 416, a LC-CDR1 with the amino acid sequence of SEQ ID NO: 404, a LC-CDR2 with the amino acid sequence of SEQ ID NO: 406, and a LC-CDR3 with the amino acid sequence of SEQ ID NO: 408; and/or (ii) a heavy chain variable domain having amino acids 20-481 of SEQ ID NO: 410, and alight chain variable domain having amino acids 20-230 of SEQ ID NO: 402;

(aa) MS-33:
(i) a HC-CDR1 with the amino acid sequence of SEQ ID NO: 428, a HC-CDR2 with the amino acid sequence of SEQ ID NO: 430, a HC-CDR3 with the amino acid sequence of SEQ ID NO: 432, a LC-CDR1 with the amino acid sequence of SEQ ID NO: 420, a LC-CDR2 with the amino acid sequence of SEQ ID NO: 422, and a LC-CDR3 with the amino acid sequence of SEQ ID NO: 424; and/or (ii) a heavy chain variable domain having amino acids 20-481 of SEQ ID NO: 426, and a light chain variable domain having amino acids 20-230 of SEQ ID NO: 418;

(bb) MS-34:
(i) a HC-CDR1 with the amino acid sequence of SEQ ID NO: 444, a HC-CDR2 with the amino acid sequence of SEQ ID NO: 446, a HC-CDR3 with the amino acid sequence of SEQ ID NO: 448, a LC-CDR1 with the amino acid sequence of SEQ ID NO: 436, a LC-CDR2 with the amino acid sequence of SEQ ID NO: 438, and a LC-CDR3 with the amino acid sequence of SEQ ID NO: 440; and/or (ii) a heavy chain variable domain having amino acids 20-481 of SEQ ID NO: 442, and a light chain variable domain having amino acids 20-230 of SEQ ID NO: 434;

(cc) MS-35:
(i) a HC-CDR1 with the amino acid sequence of SEQ ID NO: 460, a HC-CDR2 with the amino acid sequence of SEQ ID NO: 462, a HC-CDR3 with the amino acid sequence of SEQ ID NO: 464, a LC-CDR1 with the amino acid sequence of SEQ ID NO: 452, a LC-CDR2 with the amino acid sequence of SEQ ID NO: 454, and a LC-CDR3 with the amino acid sequence of SEQ ID NO: 456; and/or (ii) a heavy chain variable domain having amino acids 20-481 of SEQ ID NO: 458, and a light chain variable domain having amino acids 20-230 of SEQ ID NO: 450;

(dd) MS-36:
(i) a HC-CDR1 with the amino acid sequence of SEQ ID NO: 476, a HC-CDR2 with the amino acid sequence of SEQ ID NO: 478, a HC-CDR3 with the amino acid sequence of SEQ ID NO: 480, a LC-CDR1 with the amino acid sequence of SEQ ID NO: 468, a LC-CDR2 with the amino acid sequence of SEQ ID NO: 470, and a LC-CDR3 with the amino acid sequence of SEQ ID NO: 472; and/or (ii) a heavy chain variable domain having amino acids 20-481 of SEQ ID NO: 474, and a light chain variable domain having amino acids 20-230 of SEQ ID NO: 466;

(ee) MS-37:
(i) a HC-CDR1 with the amino acid sequence of SEQ ID NO: 492, a HC-CDR2 with the amino acid sequence of SEQ ID NO: 494, a HC-CDR3 with the amino acid sequence of SEQ ID NO: 496, a LC-CDR1 with the amino acid sequence of SEQ ID NO: 484, a LC-CDR2 with the amino acid sequence of SEQ ID NO: 486, and a LC-CDR3 with the amino acid sequence of SEQ ID NO: 488; and/or (ii) a heavy chain variable domain having amino acids 20-481 of SEQ ID NO: 490, and a light chain variable domain having amino acids 20-230 of SEQ ID NO: 482;

(ff) MS-38:
(i) a HC-CDR1 with the amino acid sequence of SEQ ID NO: 508, a HC-CDR2 with the amino acid sequence of SEQ ID NO: 510, a HC-CDR3 with the amino acid sequence of SEQ ID NO: 512, a LC-CDR1 with the amino acid sequence of SEQ ID NO: 500, a LC-CDR2 with the amino acid sequence of SEQ ID NO: 502, and a LC-CDR3 with the amino acid sequence of SEQ ID NO: 504; and/or (ii) a heavy chain variable domain having amino acids 20-481 of SEQ ID NO: 506, and alight chain variable domain having amino acids 20-230 of SEQ ID NO: 498;

(gg) MS-39:
(i) a HC-CDR1 with the amino acid sequence of SEQ ID NO: 524, a HC-CDR2 with the amino acid sequence of SEQ ID NO: 526, a HC-CDR3 with the amino acid sequence of SEQ ID NO: 528, a LC-CDR1 with the amino acid sequence of SEQ ID NO: 516, a LC-CDR2 with the amino acid sequence of SEQ ID NO: 518, and a LC-CDR3 with the amino acid sequence of SEQ ID NO: 520; and/or (ii) a heavy chain variable domain having amino acids 20-481 of SEQ ID NO: 522, and a light chain variable domain having amino acids 20-230 of SEQ ID NO: 514;

(hh) MS-40:
(i) a HC-CDR1 with the amino acid sequence of SEQ ID NO: 540, a HC-CDR2 with the amino acid sequence of SEQ ID NO: 542, a HC-CDR3 with the amino acid sequence of SEQ ID NO: 544, a LC-CDR1 with the amino acid sequence of SEQ ID NO: 532, a LC-CDR2 with the amino acid sequence of SEQ ID NO: 534, and a LC-CDR3 with the amino acid sequence of SEQ ID NO: 536; and/or (ii) a heavy chain variable domain having amino acids 20-481 of SEQ ID NO: 538, and a light chain variable domain having amino acids 20-230 of SEQ ID NO: 530;

(ii) MS-41:
(i) a HC-CDR1 with the amino acid sequence of SEQ ID NO: 556, a HC-CDR2 with the amino acid sequence of SEQ ID NO: 558, a HC-CDR3 with the amino acid sequence of SEQ ID NO: 560, a LC-CDR1 with the amino acid sequence of SEQ ID NO: 548, a LC-CDR2 with the amino acid sequence of SEQ ID NO: 550, and a LC-CDR3 with the amino acid sequence of SEQ ID NO: 552; and/or (ii) a heavy chain variable domain having amino acids 20-481 of SEQ ID NO: 554, and a light chain variable domain having amino acids 20-230 of SEQ ID NO: 546;

(jj) MS-42:
(i) a HC-CDR1 with the amino acid sequence of SEQ ID NO: 572, a HC-CDR2 with the amino acid sequence of SEQ ID NO: 574, a HC-CDR3 with the amino acid sequence of SEQ ID NO: 576, a LC-CDR1 with the amino acid sequence of SEQ ID NO: 564, a LC-CDR2 with the amino acid sequence of SEQ ID NO: 566, and a LC-CDR3 with the amino acid sequence of SEQ ID NO: 568; and/or (ii) a heavy chain variable domain having amino acids 20-481 of SEQ ID NO: 570, and a light chain variable domain having amino acids 20-230 of SEQ ID NO: 562;

(kk) MS-121:
(i) a HC-CDR1 with the amino acid sequence of SEQ ID NO: 588, a HC-CDR2 with the amino acid sequence of SEQ ID NO: 590, a HC-CDR3 with the amino acid sequence of SEQ ID NO: 592, a LC-CDR1 with the amino acid sequence of SEQ ID NO: 580, a LC-CDR2 with the amino acid sequence of SEQ ID NO: 582, and a LC-CDR3 with the amino acid sequence of SEQ ID NO: 584; and/or (ii) a heavy chain variable domain having amino acids 20-481 of SEQ ID NO: 586, and alight chain variable domain having amino acids 20-230 of SEQ ID NO: 578;

(ll) MS-122:
(i) a HC-CDR1 with the amino acid sequence of SEQ ID NO: 604, a HC-CDR2 with the amino acid sequence of SEQ ID NO: 606, a HC-CDR3 with the amino acid sequence of SEQ ID NO: 608, a LC-CDR1 with the amino acid sequence of SEQ ID NO: 596, a LC-CDR2 with the amino acid sequence of SEQ ID NO: 598, and a LC-CDR3 with the amino acid sequence of SEQ ID NO: 600; and/or (ii) a heavy chain variable domain having amino acids 20-481 of SEQ ID NO: 602, and a light chain variable domain having amino acids 20-230 of SEQ ID NO: 594;

(mm) MS-123:
(i) a HC-CDR1 with the amino acid sequence of SEQ ID NO: 620, a HC-CDR2 with the amino acid sequence of SEQ ID NO: 622, a HC-CDR3 with the amino acid sequence of SEQ ID NO: 624, a LC-CDR1 with the amino acid sequence of SEQ ID NO: 612, a LC-CDR2 with the amino acid sequence of SEQ ID NO: 614, and a LC-CDR3 with the amino acid sequence of SEQ ID NO: 616; and/or (ii) a heavy chain variable domain having amino acids 20-481 of SEQ ID NO: 618, and a light chain variable domain having amino acids 20-230 of SEQ ID NO: 610;

(nn) MS-124:
(i) a HC-CDR1 with the amino acid sequence of SEQ ID NO: 636, a HC-CDR2 with the amino acid sequence of SEQ ID NO: 638, a HC-CDR3 with the amino acid sequence of SEQ ID NO: 640, a LC-CDR1 with the amino acid sequence of SEQ ID NO: 628, a LC-CDR2 with the amino acid sequence of SEQ ID NO: 630, and a LC-CDR3 with the amino acid sequence of SEQ ID NO: 632; and/or (ii) a heavy chain variable domain having amino acids 20-481 of SEQ ID NO: 634, and a light chain variable domain having amino acids 20-230 of SEQ ID NO: 626;

(oo) MS-125:
(i) a HC-CDR1 with the amino acid sequence of SEQ ID NO: 652, a HC-CDR2 with the amino acid sequence of SEQ ID NO: 654, a HC-CDR3 with the amino acid sequence of SEQ ID NO: 656, a LC-CDR1 with the amino acid sequence of SEQ ID NO: 644, a LC-CDR2 with the amino acid sequence of SEQ ID NO: 646, and a LC-CDR3 with the amino acid sequence of SEQ ID NO: 648; and/or (ii) a heavy chain variable domain having amino acids 20-481 of SEQ ID NO: 650, and a light chain variable domain having amino acids 20-230 of SEQ ID NO: 642;

(pp) MS-126:
(i) a HC-CDR1 with the amino acid sequence of SEQ ID NO: 668, a HC-CDR2 with the amino acid sequence of SEQ ID NO: 670, a HC-CDR3 with the amino acid sequence of SEQ ID NO: 672, a LC-CDR1 with the amino acid sequence of SEQ ID NO: 660, a LC-CDR2 with the amino acid sequence of SEQ ID NO: 662, and a LC-CDR3 with the amino acid sequence of SEQ ID NO: 664; and/or (ii) a heavy chain variable domain having amino acids 20-481 of SEQ ID NO: 666, and alight chain variable domain having amino acids 20-230 of SEQ ID NO: 658;

(qq) MS-127:
(i) a HC-CDR1 with the amino acid sequence of SEQ ID NO: 684, a HC-CDR2 with the amino acid sequence of SEQ ID NO: 686, a HC-CDR3 with the amino acid sequence of SEQ ID NO: 688, a LC-CDR1 with the amino acid sequence of SEQ ID NO: 676, a LC-CDR2 with the amino acid sequence of SEQ ID NO: 678, and a LC-CDR3 with the amino acid sequence of SEQ ID NO: 680; and/or (ii) a heavy chain variable domain having amino acids 20-481 of SEQ ID NO: 682, and a light chain variable domain having amino acids 20-230 of SEQ ID NO: 674;

(rr) MS-128:
(i) a HC-CDR1 with the amino acid sequence of SEQ ID NO: 700, a HC-CDR2 with the amino acid sequence of SEQ ID NO: 702, a HC-CDR3 with the amino acid sequence of SEQ ID NO: 704, a LC-CDR1 with the amino acid sequence of SEQ ID NO: 692, a LC-CDR2 with the amino acid sequence of SEQ ID NO: 694, and a LC-CDR3 with the amino acid sequence of SEQ ID NO: 696; and/or (ii) a heavy chain variable domain having amino acids 20-481 of SEQ ID NO: 698, and a light chain variable domain having amino acids 20-230 of SEQ ID NO: 690;

(ss) MS-129:
(i) a HC-CDR1 with the amino acid sequence of SEQ ID NO: 716, a HC-CDR2 with the amino acid sequence of SEQ ID NO: 718, a HC-CDR3 with the amino acid sequence of SEQ ID NO: 720, a LC-CDR1 with the amino acid sequence of SEQ ID NO: 708, a LC-CDR2 with the amino acid sequence of SEQ ID NO: 710, and a LC-CDR3 with the amino acid sequence of SEQ ID NO: 712; and/or (ii) a heavy chain variable domain having amino acids 20-481 of SEQ ID NO: 714, and a light chain variable domain having amino acids 20-230 of SEQ ID NO: 706;

(tt) MS-130:
(i) a HC-CDR1 with the amino acid sequence of SEQ ID NO: 732, a HC-CDR2 with the amino acid sequence of SEQ ID NO: 734, a HC-CDR3 with the amino acid sequence of SEQ ID NO: 736, a LC-CDR1 with the amino acid sequence of SEQ ID NO: 724, a LC-CDR2 with the amino acid sequence of SEQ ID NO: 726, and a LC-CDR3 with the amino acid sequence of SEQ ID NO: 728; and/or (ii) a heavy chain variable domain having amino acids 20-481 of SEQ ID NO: 730, and a light chain variable domain having amino acids 20-230 of SEQ ID NO: 722;

(uu) MS-131:
(i) a HC-CDR1 with the amino acid sequence of SEQ ID NO: 748, a HC-CDR2 with the amino acid sequence of SEQ ID NO: 750, a HC-CDR3 with the amino acid sequence of SEQ ID NO: 752, a LC-CDR1 with the amino acid sequence of SEQ ID NO: 740, a LC-CDR2 with the amino acid sequence of SEQ ID NO: 742, and a LC-CDR3 with the amino acid sequence of SEQ ID NO: 744; and/or (ii) a heavy chain variable domain having amino acids 20-481 of SEQ ID NO: 746, and a light chain variable domain having amino acids 20-230 of SEQ ID NO: 738;

(vv) MS-132:
(i) a HC-CDR1 with the amino acid sequence of SEQ ID NO: 764, a HC-CDR2 with the amino acid sequence of SEQ ID NO: 766, a HC-CDR3 with the amino acid sequence of SEQ ID NO: 768, a LC-CDR1 with the amino acid sequence of SEQ ID NO: 756, a LC-CDR2 with the amino acid sequence of SEQ ID NO: 758, and a LC-CDR3 with the amino acid sequence of SEQ ID NO: 760; and/or (ii) a heavy chain variable domain having amino acids 20-481 of SEQ ID NO: 762, and a light chain variable domain having amino acids 20-230 of SEQ ID NO: 754;

(ww) MS-133:
(i) a HC-CDR1 with the amino acid sequence of SEQ ID NO: 780, a HC-CDR2 with the amino acid sequence of SEQ ID NO: 782, a HC-CDR3 with the amino acid sequence of SEQ ID NO: 784, a LC-CDR1 with the amino acid sequence of SEQ ID NO: 772, a LC-CDR2 with the amino acid sequence of SEQ ID NO: 774, and a LC-CDR3 with the amino acid sequence of SEQ ID NO: 776; and/or (ii) a heavy chain variable domain having amino acids 20-481 of SEQ ID NO: 778, and a light chain variable domain having amino acids 20-230 of SEQ ID NO: 770;

(xx) MS-134:
(i) a HC-CDR1 with the amino acid sequence of SEQ ID NO: 796, a HC-CDR2 with the amino acid sequence of SEQ ID NO: 798, a HC-CDR3 with the amino acid sequence of SEQ ID NO: 800, a LC-CDR1 with the amino acid sequence of SEQ ID NO: 788, a LC-CDR2 with the amino acid sequence of SEQ ID NO: 790, and a LC-CDR3 with the amino acid sequence of SEQ ID NO: 792; and/or (ii) a heavy chain variable domain having amino acids 20-481 of SEQ ID NO: 794, and alight chain variable domain having amino acids 20-230 of SEQ ID NO: 786;

(yy) MS-135:
(i) a HC-CDR1 with the amino acid sequence of SEQ ID NO: 812, a HC-CDR2 with the amino acid sequence of SEQ ID NO: 814, a HC-CDR3 with the amino acid sequence of SEQ ID NO: 816, a LC-CDR1 with the amino acid sequence of SEQ ID NO: 804, a LC-CDR2 with the amino acid sequence of SEQ ID NO: 806, and a LC-CDR3 with the amino acid sequence of SEQ ID NO: 808; and/or (ii) a heavy chain variable domain having amino acids 20-481 of SEQ ID NO: 810, and a light chain variable domain having amino acids 20-230 of SEQ ID NO: 802;

(zz) MS-136:
(i) a HC-CDR1 with the amino acid sequence of SEQ ID NO: 828, a HC-CDR2 with the amino acid sequence of SEQ ID NO: 830, a HC-CDR3 with the amino acid sequence of SEQ ID NO: 832, a LC-CDR1 with the amino acid sequence of SEQ ID NO: 820, a LC-CDR2 with the amino acid sequence of SEQ ID NO: 822, and a LC-CDR3 with the amino acid sequence of SEQ ID NO: 824; and/or (ii) a heavy chain variable domain having amino acids 20-481 of SEQ ID NO: 826, and alight chain variable domain having amino acids 20-230 of SEQ ID NO: 818;

(aaa) MS-137:
(i) a HC-CDR1 with the amino acid sequence of SEQ ID NO: 844, a HC-CDR2 with the amino acid sequence of SEQ ID NO: 846, a HC-CDR3 with the amino acid sequence of SEQ ID NO: 848, a LC-CDR1 with the amino acid sequence of SEQ ID NO: 836, a LC-CDR2 with the amino acid sequence of SEQ ID NO: 838, and a LC-CDR3 with the amino acid sequence of SEQ ID NO: 840; and/or (ii) a heavy chain variable domain having amino acids 20-481 of SEQ ID NO: 842, and a light chain variable domain having amino acids 20-230 of SEQ ID NO: 834;

(bbb) MS-138:
(i) a HC-CDR1 with the amino acid sequence of SEQ ID NO: 860, a HC-CDR2 with the amino acid sequence of SEQ ID NO: 862, a HC-CDR3 with the amino acid sequence of SEQ ID NO: 864, a LC-CDR1 with the amino acid sequence of SEQ ID NO: 852, a LC-CDR2 with the amino acid sequence of SEQ ID NO: 854, and a LC-CDR3 with the amino acid sequence of SEQ ID NO: 856; and/or (ii) a heavy chain variable domain having amino acids 20-481 of SEQ ID NO: 858, and a light chain variable domain having amino acids 20-230 of SEQ ID NO: 850;

(ccc) MS-139:
(i) a HC-CDR1 with the amino acid sequence of SEQ ID NO: 876, a HC-CDR2 with the amino acid sequence of SEQ ID NO: 878, a HC-CDR3 with the amino acid sequence of SEQ ID NO: 880, a LC-CDR1 with the amino acid sequence of SEQ ID NO: 868, a LC-CDR2 with the amino acid sequence of SEQ ID NO: 870, and a LC-CDR3 with the amino acid sequence of SEQ ID NO: 872; and/or (ii) a heavy chain variable domain having amino acids 20-481 of SEQ ID NO: 874, and a light chain variable domain having amino acids 20-230 of SEQ ID NO: 866;

(ddd) MS-140:
(i) a HC-CDR1 with the amino acid sequence of SEQ ID NO: 892, a HC-CDR2 with the amino acid sequence of SEQ ID NO: 894, a HC-CDR3 with the amino acid sequence of SEQ ID NO: 896, a LC-CDR1 with the amino acid sequence of SEQ ID NO: 884, a LC-CDR2 with the amino acid sequence of SEQ ID NO: 886, and a LC-CDR3 with the amino acid sequence of SEQ ID NO: 888; and/or (ii) a heavy chain variable domain having amino acids 20-481 of SEQ ID NO: 890, and a light chain variable domain having amino acids 20-230 of SEQ ID NO: 882;

(eee) MS-141:
(i) a HC-CDR1 with the amino acid sequence of SEQ ID NO: 908, a HC-CDR2 with the amino acid sequence of SEQ ID NO: 910, a HC-CDR3 with the amino acid sequence of SEQ ID NO: 912, a LC-CDR1 with the amino acid sequence of SEQ ID NO: 900, a LC-CDR2 with the amino acid sequence of SEQ ID NO: 902, and a LC-CDR3 with the amino acid sequence of SEQ ID NO: 904; and/or (ii) a heavy chain variable domain having amino acids 20-481 of SEQ ID NO: 906, and alight chain variable domain having amino acids 20-230 of SEQ ID NO: 898;

(fff) MS-142:
(i) a HC-CDR1 with the amino acid sequence of SEQ ID NO: 924, a HC-CDR2 with the amino acid sequence of SEQ ID NO: 926, a HC-CDR3 with the amino acid sequence of SEQ ID NO: 928, a LC-CDR1 with the amino acid sequence of SEQ ID NO: 916, a LC-CDR2 with the amino acid sequence of SEQ ID NO: 918, and a LC-CDR3 with the amino acid sequence of SEQ ID NO: 920; and/or (ii) a heavy chain variable domain having amino acids 20-481 of SEQ ID NO: 922, and a light chain variable domain having amino acids 20-230 of SEQ ID NO: 914;

(ggg) MS-143:
(i) a HC-CDR1 with the amino acid sequence of SEQ ID NO: 940, a HC-CDR2 with the amino acid sequence of SEQ ID NO: 942, a HC-CDR3 with the amino acid sequence of SEQ ID NO: 944, a LC-CDR1 with the amino acid sequence of SEQ ID NO: 932, a LC-CDR2 with the amino acid sequence of SEQ ID NO: 934, and a LC-CDR3 with the amino acid sequence of SEQ ID NO: 936; and/or (ii) a heavy chain variable domain having amino acids 20-481 of SEQ ID NO: 938, and a light chain variable domain having amino acids 20-230 of SEQ ID NO: 930;

(hhh) MS-144:
(i) a HC-CDR1 with the amino acid sequence of SEQ ID NO: 956, a HC-CDR2 with the amino acid sequence of SEQ ID NO: 958, a HC-CDR3 with the amino acid sequence of SEQ ID NO: 960, a LC-CDR1 with the amino acid sequence of SEQ ID NO: 948, a LC-CDR2 with the amino acid sequence of SEQ ID NO: 950, and a LC-CDR3 with the amino acid sequence of SEQ ID NO: 952; and/or (ii) a heavy chain variable domain having amino acids 20-481 of SEQ ID NO: 954, and a light chain variable domain having amino acids 20-230 of SEQ ID NO: 946;

(iii) MS-145:
(i) a HC-CDR1 with the amino acid sequence of SEQ ID NO: 972, a HC-CDR2 with the amino acid sequence of SEQ ID NO: 974, a HC-CDR3 with the amino acid sequence of SEQ ID NO: 976, a LC-CDR1 with the amino acid sequence of SEQ ID NO: 964, a LC-CDR2 with the amino acid sequence of SEQ ID NO: 966, and a LC-CDR3 with the amino acid sequence of SEQ ID NO: 968; and/or (ii) a heavy chain variable domain having amino acids 20-481 of SEQ ID NO: 970, and alight chain variable domain having amino acids 20-230 of SEQ ID NO: 962;

(jjj) MS-146:
(i) a HC-CDR1 with the amino acid sequence of SEQ ID NO: 988, a HC-CDR2 with the amino acid sequence of SEQ ID NO: 990, a HC-CDR3 with the amino acid sequence of SEQ ID NO: 992, a LC-CDR1 with the amino acid sequence of SEQ ID NO: 980, a LC-CDR2 with the amino acid sequence of SEQ ID NO: 982, and a LC-CDR3 with the amino acid sequence of SEQ ID NO: 984; and/or (ii) a heavy chain variable domain having amino acids 20-481 of SEQ ID NO: 986, and alight chain variable domain having amino acids 20-230 of SEQ ID NO: 978;

(kkk) MS-399:
(i) a HC-CDR1 with the amino acid sequence of SEQ ID NO: 1004, a HC-CDR2 with the amino acid sequence of SEQ ID NO: 1006, a HC-CDR3 with the amino acid sequence of SEQ ID NO: 1008, a LC-CDR1 with the amino acid sequence of SEQ ID NO: 996, a LC-CDR2 with the amino acid sequence of SEQ ID NO: 998, and a LC-CDR3 with the amino acid sequence of SEQ ID NO: 1000; and/or (ii) a heavy chain variable domain having amino acids 20-481 of SEQ ID NO: 1002, and a light chain variable domain having amino acids 20-230 of SEQ ID NO: 994;

(lll) MS-400:
(i) a HC-CDR1 with the amino acid sequence of SEQ ID NO: 1020, a HC-CDR2 with the amino acid sequence of SEQ ID NO: 1022, a HC-CDR3 with the amino acid sequence of SEQ ID NO: 1024, a LC-CDR1 with the amino acid sequence of SEQ ID NO: 1012, a LC-CDR2 with the amino acid sequence of SEQ ID NO: 1014, and a LC-CDR3 with the amino acid sequence of SEQ ID NO: 1016; and/or (ii) a heavy chain variable domain having amino acids 20-481 of SEQ ID NO: 1018, and a light chain variable domain having amino acids 20-230 of SEQ ID NO: 1010;

(mmm) MS-401:
(i) a HC-CDR1 with the amino acid sequence of SEQ ID NO: 1036, a HC-CDR2 with the amino acid sequence of SEQ ID NO: 1038, a HC-CDR3 with the amino acid sequence of SEQ ID NO: 1040, a LC-CDR1 with the amino acid sequence of SEQ ID NO: 1028, a LC-CDR2 with the amino acid sequence of SEQ ID NO: 1030, and a LC-CDR3 with the amino acid sequence of SEQ ID NO: 1032; and/or (ii) a heavy chain variable domain having amino acids 20-481 of SEQ ID NO: 1034, and a light chain variable domain having amino acids 20-230 of SEQ ID NO: 1026;

(nnn) MS-402:
(i) a HC-CDR1 with the amino acid sequence of SEQ ID NO: 1052, a HC-CDR2 with the amino acid sequence of SEQ ID NO: 1054, a HC-CDR3 with the amino acid sequence of SEQ ID NO: 1056, a LC-CDR1 with the amino acid sequence of SEQ ID NO: 1044, a LC-CDR2 with the amino acid sequence of SEQ ID NO: 1046, and a LC-CDR3 with the amino acid sequence of SEQ ID NO: 1048; and/or (ii) a heavy chain variable domain having amino acids 20-481 of SEQ ID NO: 1050, and a light chain variable domain having amino acids 20-230 of SEQ ID NO: 1042;

(ooo) MS-403:
(i) a HC-CDR1 with the amino acid sequence of SEQ ID NO: 1068, a HC-CDR2 with the amino acid sequence of SEQ ID NO: 1070, a HC-CDR3 with the amino acid sequence of SEQ ID NO: 1072, a LC-CDR1 with the amino acid sequence of SEQ ID NO: 1060, a LC-CDR2 with the amino acid sequence of SEQ ID NO: 1062, and a LC-CDR3 with the amino acid sequence of SEQ ID NO: 1064; and/or (ii) a heavy chain variable domain having amino acids 20-481 of SEQ ID NO: 1066, and a light chain variable domain having amino acids 20-230 of SEQ ID NO: 1058;

(ppp) MS-404:
(i) a HC-CDR1 with the amino acid sequence of SEQ ID NO: 1084, a HC-CDR2 with the amino acid sequence of SEQ ID NO: 1086, a HC-CDR3 with the amino acid sequence of SEQ ID NO: 1088, a LC-CDR1 with the amino acid sequence of SEQ ID NO: 1076, a LC-CDR2 with the amino acid sequence of SEQ ID NO: 1078, and a LC-CDR3 with the amino acid sequence of SEQ ID NO: 1080; and/or (ii) a heavy chain variable domain having amino acids 20-481 of SEQ ID NO: 1082, and a light chain variable domain having amino acids 20-230 of SEQ ID NO: 1074;

(qqq) MS-405:
(i) a HC-CDR1 with the amino acid sequence of SEQ ID NO: 1100, a HC-CDR2 with the amino acid sequence of SEQ ID NO: 1102, a HC-CDR3 with the amino acid sequence of SEQ ID NO: 1104, a LC-CDR1 with the amino acid sequence of SEQ ID NO: 1092, a LC-CDR2 with the amino acid sequence of SEQ ID NO: 1094, and a LC-CDR3 with the amino acid sequence of SEQ ID NO: 1096; and/or (ii) a heavy chain variable domain having amino acids 20-481 of SEQ ID NO: 1098, and a light chain variable domain having amino acids 20-230 of SEQ ID NO: 1090;

(rrr) MS-406:
(i) a HC-CDR1 with the amino acid sequence of SEQ ID NO: 1116, a HC-CDR2 with the amino acid sequence of SEQ ID NO: 1118, a HC-CDR3 with the amino acid sequence of SEQ ID NO: 1120, a LC-CDR1 with the amino acid sequence of SEQ ID NO: 1108, a LC-CDR2 with the amino acid sequence of SEQ ID NO: 1110, and a LC-CDR3 with the amino acid sequence of SEQ ID NO: 1112; and/or (ii) a heavy chain variable domain having amino acids 20-481 of SEQ ID NO: 1114, and a light chain variable domain having amino acids 20-230 of SEQ ID NO: 1106;

(sss) MS-407:
(i) a HC-CDR1 with the amino acid sequence of SEQ ID NO: 1132, a HC-CDR2 with the amino acid sequence of SEQ ID NO: 1134, a HC-CDR3 with the amino acid sequence of SEQ ID NO: 1136, a LC-CDR1 with the amino acid sequence of SEQ ID NO: 1124, a LC-CDR2 with the amino acid sequence of SEQ ID NO: 1126, and a LC-CDR3 with the amino acid sequence of SEQ ID NO: 1128; and/or (ii) a heavy chain variable domain having amino acids 20-481 of SEQ ID NO: 1130, and a light chain variable domain having amino acids 20-230 of SEQ ID NO: 1122;

(ttt) MS-408:
(i) a HC-CDR1 with the amino acid sequence of SEQ ID NO: 1148, a HC-CDR2 with the amino acid sequence of SEQ ID NO: 1150, a HC-CDR3 with the amino acid sequence of SEQ ID NO: 1152, a LC-CDR1 with the amino acid sequence of SEQ ID NO: 1140, a LC-CDR2 with the amino acid sequence of SEQ ID NO: 1142, and a LC-CDR3 with the amino acid sequence of SEQ ID NO: 1144; and/or (ii) a heavy chain variable domain having amino acids 20-481 of SEQ ID NO: 1146, and a light chain variable domain having amino acids 20-230 of SEQ ID NO: 1138;

(uuu) MS-409:
(i) a HC-CDR1 with the amino acid sequence of SEQ ID NO: 1164, a HC-CDR2 with the amino acid sequence of SEQ ID NO: 1166, a HC-CDR3 with the amino acid sequence of SEQ ID NO: 1168, a LC-CDR1 with the amino acid sequence of SEQ ID NO: 1156, a LC-CDR2 with the amino acid sequence of SEQ ID NO: 1158, and a LC-CDR3 with the amino acid sequence of SEQ ID NO: 1160; and/or (ii) a heavy chain variable domain having amino acids 20-481 of SEQ ID NO: 1162, and a light chain variable domain having amino acids 20-230 of SEQ ID NO: 1154;

(vvv) MS-410:
(i) a HC-CDR1 with the amino acid sequence of SEQ ID NO: 1180, a HC-CDR2 with the amino acid sequence of SEQ ID NO: 1182, a HC-CDR3 with the amino acid sequence of SEQ ID NO: 1184, a LC-CDR1 with the amino acid sequence of SEQ ID NO: 1172, a LC-CDR2 with the amino acid sequence of SEQ ID NO: 1174, and a LC-CDR3 with the amino acid sequence of SEQ ID NO: 1176; and/or (ii) a heavy chain variable domain having amino acids 20-481 of SEQ ID NO: 1178, and a light chain variable domain having amino acids 20-230 of SEQ ID NO: 1170;

(www) MS-411:
(i) a HC-CDR1 with the amino acid sequence of SEQ ID NO: 1196, a HC-CDR2 with the amino acid sequence of SEQ ID NO: 1198, a HC-CDR3 with the amino acid sequence of SEQ ID NO: 1200, a LC-CDR1 with the amino acid sequence of SEQ ID NO: 1188, a LC-CDR2 with the amino acid sequence of SEQ ID NO: 1190, and a LC-CDR3 with the amino acid sequence of SEQ ID NO: 1192; and/or (ii) a heavy chain variable domain having amino acids 20-481 of SEQ ID NO: 1194, and a light chain variable domain having amino acids 20-230 of SEQ ID NO: 1186;

(xxx) MS-412:
(i) a HC-CDR1 with the amino acid sequence of SEQ ID NO: 1212, a HC-CDR2 with the amino acid sequence of SEQ ID NO: 1214, a HC-CDR3 with the amino acid sequence of SEQ ID NO: 1216, a LC-CDR1 with the amino acid sequence of SEQ ID NO: 1204, a LC-CDR2 with the amino acid sequence of SEQ ID NO: 1206, and a LC-CDR3 with the amino acid sequence of SEQ ID NO: 1208; and/or (ii) a heavy chain variable domain having amino acids 20-481 of SEQ ID NO: 1210, and a light chain variable domain having amino acids 20-230 of SEQ ID NO: 1202;

(yyy) MS-413:
(i) a HC-CDR1 with the amino acid sequence of SEQ ID NO: 1228, a HC-CDR2 with the amino acid sequence of SEQ ID NO: 1230, a HC-CDR3 with the amino acid sequence of SEQ ID NO: 1232, a LC-CDR1 with the amino acid sequence of SEQ ID NO: 1220, a LC-CDR2 with the amino acid sequence of SEQ ID NO: 1222, and a LC-CDR3 with the amino acid sequence of SEQ ID NO: 1224; and/or (ii) a heavy chain variable domain having amino acids 20-481 of SEQ ID NO: 1226, and a light chain variable domain having amino acids 20-230 of SEQ ID NO: 1218;

(zzz) MS-414:
(i) a HC-CDR1 with the amino acid sequence of SEQ ID NO: 1244, a HC-CDR2 with the amino acid sequence of SEQ ID NO: 1246, a HC-CDR3 with the amino acid sequence of SEQ ID NO: 1248, a LC-CDR1 with the amino acid sequence of SEQ ID NO: 1236, a LC-CDR2 with the amino acid sequence of SEQ ID NO: 1238, and a LC-CDR3 with the amino acid sequence of SEQ ID NO: 1240; and/or (ii) a heavy chain variable domain having amino acids 20-481 of SEQ ID NO: 1242, and a light chain variable domain having amino acids 20-230 of SEQ ID NO: 1234;

(aaaa) MS-437:
(i) a HC-CDR1 with the amino acid sequence of SEQ ID NO: 1260, a HC-CDR2 with the amino acid sequence of SEQ ID NO: 1262, a HC-CDR3 with the amino acid sequence of SEQ ID NO: 1264, a LC-CDR1 with the amino acid sequence of SEQ ID NO: 1252, a LC-CDR2 with the amino acid sequence of SEQ ID NO: 1254, and a LC-CDR3 with the amino acid sequence of SEQ ID NO: 1256; and/or (ii) a heavy chain variable domain having amino acids 20-481 of SEQ ID NO: 1258, and a light chain variable domain having amino acids 20-230 of SEQ ID NO: 1250;

(bbbb) MS-438:
(i) a HC-CDR1 with the amino acid sequence of SEQ ID NO: 1276, a HC-CDR2 with the amino acid sequence of SEQ ID NO: 1278, a HC-CDR3 with the amino acid sequence of SEQ ID NO: 1280, a LC-CDR1 with the amino acid sequence of SEQ ID NO: 1268, a LC-CDR2 with the amino acid sequence of SEQ ID NO: 1270, and a LC-CDR3 with the amino acid sequence of SEQ ID NO: 1272; and/or (ii) a heavy chain variable domain having amino acids 20-481 of SEQ ID NO: 1274, and a light chain variable domain having amino acids 20-230 of SEQ ID NO: 1266;

(cccc) MS-439:
(i) a HC-CDR1 with the amino acid sequence of SEQ ID NO: 1292, a HC-CDR2 with the amino acid sequence of SEQ ID NO: 1294, a HC-CDR3 with the amino acid sequence of SEQ ID NO: 1296, a LC-CDR1 with the amino acid sequence of SEQ ID NO: 1284, a LC-CDR2 with the amino acid sequence of SEQ ID NO: 1286, and a LC-CDR3 with the amino acid sequence of SEQ ID NO: 1288; and/or (ii) a heavy chain variable domain having amino acids 20-481 of SEQ ID NO: 1290, and a light chain variable domain having amino acids 20-230 of SEQ ID NO: 1282;

(dddd) MS-440:
(i) a HC-CDR1 with the amino acid sequence of SEQ ID NO: 1308, a HC-CDR2 with the amino acid sequence of SEQ ID NO: 1310, a HC-CDR3 with the amino acid sequence of SEQ ID NO: 1312, a LC-CDR1 with the amino acid sequence of SEQ ID NO: 1300, a LC-CDR2 with the amino acid sequence of SEQ ID NO: 1302, and a LC-CDR3 with the amino acid sequence of SEQ ID NO: 1304; and/or (ii) a heavy chain variable domain having amino acids 20-481 of SEQ ID NO: 1306, and a light chain variable domain having amino acids 20-230 of SEQ ID NO: 1298;

(eeee) MS-441:
(i) a HC-CDR1 with the amino acid sequence of SEQ ID NO: 1324, a HC-CDR2 with the amino acid sequence of SEQ ID NO: 1326, a HC-CDR3 with the amino acid sequence of SEQ ID NO: 1328, a LC-CDR1 with the amino acid sequence of SEQ ID NO: 1316, a LC-CDR2 with the amino acid sequence of SEQ ID NO: 1318, and a LC-CDR3 with the amino acid sequence of SEQ ID NO: 1320; and/or (ii) a heavy chain variable domain having amino acids 20-481 of SEQ ID NO: 1322, and a light chain variable domain having amino acids 20-230 of SEQ ID NO: 1314;

(ffff) MS-442:
(i) a HC-CDR1 with the amino acid sequence of SEQ ID NO: 1340, a HC-CDR2 with the amino acid sequence of SEQ ID NO: 1342, a HC-CDR3 with the amino acid sequence of SEQ ID NO: 1344, a LC-CDR1 with the amino acid sequence of SEQ ID NO: 1332, a LC-CDR2 with the amino acid sequence of SEQ ID NO: 1334, and a LC-CDR3 with the amino acid sequence of SEQ ID NO: 1336; and/or (ii) a heavy chain variable domain having amino acids 20-481 of SEQ ID NO: 1338, and a light chain variable domain having amino acids 20-230 of SEQ ID NO: 1330;

(gggg) MS-443:
(i) a HC-CDR1 with the amino acid sequence of SEQ ID NO: 1356, a HC-CDR2 with the amino acid sequence of SEQ ID NO: 1358, a HC-CDR3 with the amino acid sequence of SEQ ID NO: 1360, a LC-CDR1 with the amino acid sequence of SEQ ID NO: 1348, a LC-CDR2 with the amino acid sequence of SEQ ID NO: 1350, and a LC-CDR3 with the amino acid sequence of SEQ ID NO: 1352; and/or (ii) a heavy chain variable domain having amino acids 20-481 of SEQ ID NO: 1354, and a light chain variable domain having amino acids 20-230 of SEQ ID NO: 1346;

(hhhh) MS-444:
(i) a HC-CDR1 with the amino acid sequence of SEQ ID NO: 1372, a HC-CDR2 with the amino acid sequence of SEQ ID NO: 1374, a HC-CDR3 with the amino acid sequence of SEQ ID NO: 1376, a LC-CDR1 with the amino acid sequence of SEQ ID NO: 1364, a LC-CDR2 with the amino acid sequence of SEQ ID NO: 1366, and a LC-CDR3 with the amino acid sequence of SEQ ID NO: 1368; and/or (ii) a heavy chain variable domain having amino acids 20-481 of SEQ ID NO: 1370, and a light chain variable domain having amino acids 20-230 of SEQ ID NO: 1362; or
(iiii) MS-445:
(i) a HC-CDR1 with the amino acid sequence of SEQ ID NO: 1388, a HC-CDR2 with the amino acid sequence of SEQ ID NO: 1390, a HC-CDR3 with the amino acid sequence of SEQ ID NO: 1392, a LC-CDR1 with the amino acid sequence of SEQ ID NO: 1380, a LC-CDR2 with the amino acid sequence of SEQ ID NO: 1382, and a LC-CDR3 with the amino acid sequence of SEQ ID NO: 1384; and/or (ii) a heavy chain variable domain having amino acids 20-481 of SEQ ID NO: 1386, and a light chain variable domain having amino acids 20-230 of SEQ ID NO: 1378.

Any of the PGT121 variant antibodies or fragments thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445)) can be modified in their heavy and light chain CDR sequences or framework regions to include one or more insertions, deletions, or substitutions, so long as the mutation(s) noted in Tables 1 and 2 for each respective antibody are maintained.

The heavy and light chain variable domain of the PGT121 variant antibody or antigen-binding fragment thereof featured herein may be preceded by a signal peptide corresponding to amino acids 1-19 of the light and heavy chain domains of the PGT121 variant antibody or antigen-binding fragment thereof (see, e.g., amino acids 1-19 of SEQ ID NOs: 2 and 10, respectively). The signal peptide may be included in the amino acid sequences for the light and heavy chain domains of the PGT121 variant antibody or antigen-binding fragment thereof (and encoded by the nucleic acid molecule corresponding to the PGT121 variant antibody or antigen-binding fragment thereof) for the purpose of expressing the PGT121 variant antibody or antigen-binding fragment thereof in an expression system (e.g., a mammalian expression system), in which the signal peptide is cleaved during maturation of the PGT121 variant antibody or antigen-binding fragment thereof and secretion from the cell expressing the PGT121 variant antibody or antigen-binding fragment thereof. The sequence identifiers for the amino acid sequences of the heavy and light chain variable domains of the PGT121 antibody variants or antigen-binding fragments thereof described herein may include amino acids 1-19 of the signal peptide. Thus, residue number 1 of the mature form of the heavy and light chain variable domains of the PGT121 antibody variants or antigen-binding fragments thereof described herein may begin at amino acid residue 20. All the mutations described herein refer to the location of the mutated residue in the mature linear form (the mature linear form lacking the signal peptide corresponding to residues 1-19; e.g., the light chain variable domain mutation S1P refers to a S-to-P substitution at position 1 of the mature linear form of the antibody light chain domain, which corresponds to position 20 in the amino acid sequence with the signal peptide (see, e.g., SEQ ID NO: 18 of MS-22 from Table 1).

In specific embodiments, the PGT121 variant antibody or antigen-binding fragment thereof is selected from the group consisting of (b), (c), (d), (e), (f), (g), (h), (i), (j), (k), (l), (m), (n), (o), (p), (q), (r), (s), (t), (u), (v), (w), (x), (y), (dd), (ee), (hh), (kkk), (lll), (mmm), (nnn), (ooo), (ppp), (qqq), (rrr), (sss), (ttt), (uuu), (vvv), (www), (xxx), (yyy), (zzz), (aaaa), (bbbb), (cccc), (dddd), (eeee), (ffff), (gggg), (hhhh), and (iiii) noted above. In preferred embodiments, the antibody or antigen-binding fragment is selected from the group consisting of (dd), (ee), (hh), and (zzz). In other embodiments, the CDR sequences noted above for (a)-(iiii) may differ by one, two, three, four, or five amino acid residues. The amino acid substitution in the CDR(s), if present, may be a conservative amino acid substitution.

In certain instances, as compared to an antibody or antigen-binding fragment thereof lacking the at least one mutation in the heavy chain variable domain and/or the light chain variable domain, the featured antibody or antigen-binding fragment thereof described herein exhibits one or more of the following properties: (i) neutralization of one or more of the following pseudoviruses of HIV: RHPA4259.7, Du172.17, CNE52, 0260.v5.c36, SC05.8C11.2344, Ce1176_A3, SC422661.8, BB1012-11.TC21, 263-8, X1193_c1, AC10.0.29, and 6952.v1.c20; (ii) increased solubility, in which at least 1 mg/ml (e.g., 0.1 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, 1 mg/ml, 1.5 mg/ml, 2.0 mg/ml, 2.5 mg/ml, 3.0 mg/ml, 3.5 mg/ml, 4.0 mg/ml, 4.5 mg/ml, 5.0 mg/ml, 5.5 mg/ml, 6.0 mg/ml, 6.5 mg/ml, 7.0 mg/ml, 7.5 mg/ml, 8.0 mg/ml, 8.5 mg/ml, 9.0 mg/ml, 9.5 mg/ml, or 10.0 mg/ml) of the antibody or antigen-binding fragment thereof is soluble in a solution containing 6-9% PEG 10,000 (e.g., 6.1%, 6.2%, 6.3%, 6.4%, 6.5%, 6.6%, 6.7%, 6.8%, 6.9%, 7.0%, 7.1%, 7.2%, 7.3%, 7.4%, 7.5%, 7.6%, 7.7%, 7.8%, 7.9%, 8.0%, 8.1%, 8.2%, 8.3%, 8.4%, 8.5%, 8.6%, 8.7%, 8.8%, 8.9%, or 9% PEG 10,000), wherein preferably 1 mg/ml of the antibody or fragment thereof is soluble in a solution with a concentration of 7.9% PEG 10,000; (iii) increased stability (e.g., a reduction in aggregation and/or formation of high molecular weight species of at least 1%, 2%, 3%, 4%, 5%, 6%, 7%, 8%, 9%, 10%, 15%, 20%, 25%, or 30%, or more) at low pH, such as at a pH of less than 5.0 (e.g., pH less than 4.6, pH less than 4.3, pH less than 4.0, or pH less than 3.6), or at pH 3.5, pH 3.4, or pH 3.3); (iv) increased thermal stability (e.g., an increase in the melting temperature of at least 1° C., 2° C., 3° C., 4° C., 5° C., 6° C., 7° C., 8° C., 9° C., 10° C. or more, relative to a PGT121 antibody without the at least one mutation), such as stability at a temperature in the range of about 20-95° C. (e.g., about 20° C., 25° C., 30° C., 35° C., 40° C., 45° C., 50° C., 55° C., 60° C., 65° C. 70° C., 75° C., 80° C., 85° C., 90° C., or 95° C.); and/or (v) increased chemical stability (e.g., as assessed by resistance of the PGT121 variant antibody or antigen-binding fragment thereof to chemical denaturation, such as by guanidine hydrochloride (GuHCl), such as GuHCl in an amount of greater than 3 M (e.g., greater than 3.5 M, greater than 4.0 M, greater than 4.5 M, greater than 5.0 M, greater than 5.5 M, or equal to 6.0 M). In certain embodiments, the featured antibody or antigen-binding fragment thereof exhibits reduced aggregation (e.g., the monomer content is more than about 60% (e.g., more than about 65%, 70%, 75%, 80%, 85%, 90%, 91%, 92%, 93%, 94%, 95%, 96%, 97%, 98%, or 99%), and/or the oligomer content is less than about 10% (e.g., less than about 9%, 8%, 7%, 6%, 5%, 4%, 3%, 2%, 1%, 0.5%, 0.4%, 0.3%, 0.2%, or 0.1%)). Thus the antibody or antigen-binding fragment thereof exhibits improved manufacturability (e.g., reduced aggregation during manufacture) and storage stability (e.g., does not aggregate (e.g., percent oligomer increase is less than about 5%, less than about 1%, less than about 0.9%, less than about 0.8%, less than about 0.7%, less than about 0.6%, less than about 0.5%, less than about 0.4%, less than about 0.3%, less than about 0.2%, less than about 0.1%, less than about 0.09%, less than about 0.08%, less than about 0.07%, less than about 0.06%, less than about 0.05%, less than about 0.04%, less than about 0.03%, less than about 0.02%, or less than about 0.01%) during storage over a period of time (e.g., storage over 2 days, 3 days, 4 days, 5 days, 6 days, 1 week, 2 weeks, 3 weeks, 1 month, 2 months, 3 months, 4 months, 5 months, 6 months, 1 year, 2 years, 3 years, 4 years, 5 years, or more)), such as at a temperature of about −40° C. to 50° C. (e.g., about −40° C., −35° C., −30° C., −25° C., −20° C., −15° C., −10° C., −5° C., 0° C., 5° C., 10° C., 15° C., 20° C., 25° C., 30° C., 35° C., 40° C., 45° C., or 50° C.).

In some embodiments, the antibody or antigen-binding fragment thereof featured herein has a half-life of at least about 1 hour (e.g., at least about 1 hour, 2 hour, 3 hour, 4 hour, 5 hour, 6 hour, 7 hour, 8 hour, 9 hour, 10 hour, 11 hour, 12 hour, 13 hour, 14 hour 15 hour, 16 hour, 17 hour, 18 hour, 19 hour, 20 hour, 21 hour, 22 hour, 23 hour, 1 day, 2 day, 3 day, 4 day, 5 day, 6 day, 7 day, 8 day, 9 day, 10 day, 11 day, 12 day, 13 day, 14 day, 15 day, 16 day, 17 day, 18 day, 19 day, 20 day, 21 day, 22 day, 23 day, 24 day, 25 day, 26 day, 27 day, 28 day, or more) in vitro or in vivo (e.g., in a fluid, such as blood, following administration to a subject (e.g., a human)).

In some embodiments, the antibody or antigen-binding fragment thereof is one or more of a monoclonal antibody or antigen-binding fragment thereof, a polyclonal antibody or antigen-binding fragment thereof, a human antibody or antigen-binding fragment thereof, a humanized antibody or antigen-binding fragment thereof, a primatized antibody or antigen-binding fragment thereof, a bispecific antibody or antigen-binding fragment thereof, a multi-specific antibody or antigen-binding fragment thereof, a dual-variable immunoglobulin domain, a monovalent antibody or antigen-binding fragment thereof, a chimeric antibody or antigen-binding fragment thereof, a single-chain Fv molecule (scFv), a diabody, a triabody, a nanobody, an antibody-like protein scaffold, a domain antibody, a Fv fragment, a Fab fragment, a F(ab')2 molecule, and a tandem scFv (taFv).

Also featured is a polynucleotide encoding the antibody or antigen-binding fragment thereof, and a vector (e.g., an expression vector, such as a prokaryotic or eukaryotic expression vector) containing the polynucleotide. In certain embodiments, the vector is a viral vector, such as an adenovirus (Ad) vector (e.g., a serotype 2, 5, 11, 12, 24, 26, 34, 35, 40, 48, 49, 50, 52, or Pan9 adenovirus, or a human, chimpanzee, or rhesus adenovirus), a retrovirus (e.g., a γ-retrovirus or a lentivirus), a poxvirus, an adeno-associated virus, a baculovirus, a herpes simplex virus, and a vaccinia virus (e.g., a modified vaccinia Ankara (MVA)). Further featured is a host cell, such as a prokaryotic cell or a eukaryotic cell (e.g., a mammalian cell, such as a Chinese Hamster Ovary (CHO) cell or a Human Embryonic Kidney 293 (HEK293) cell) containing the polynucleotide or the vector.

Also featured herein is a composition with the aforementioned antibody or antigen-binding fragment thereof, the polynucleotide encoding the antibody or antigen-binding fragment thereof, the vector containing the polynucleotide, or the host cell with the polynucleotide or the vector (e.g., a prokaryotic cell or a eukaryotic cell (e.g., a mammalian cell, such as a CHO or a HEK293 cell)). In some instances, the composition further includes a pharmaceutically acceptable carrier, excipient, or diluent.

In additional instances, the composition further includes an immunomodulator (e.g., AS-101, Bropirimine, Acemannan, CL246,738, EL10, FP-21399, GammaInterferon, Granulocyte Macrophage Colony Stimulating Factor, HIV Core Particle Immunostimulant, IL-2, Immune Globulin Intravenous, IMREG-1, IMREG-2, Imuthiol Diethyl Dithio Carbamate, Alpha-2 Interferon, Methionine-Enkephalin, MTP-PE Muramyl-Tripeptide, Granulocyte Colony Stimulating Factor, Remune, CD4 (e.g., recombinant soluble CD4), rCD4-IgG hybrids, SK&F106528 Soluble T4, Thymopentin, Tumor Necrosis Factor, or Infliximab. In added embodiments, the composition further includes at least one reservoir activator, such as a PKC agonist (e.g., a phorbol ester, a macrocyclic lactone such as bryostatin-1, or a diterpene such as an ingenol compound), a cytokine or chemokine (e.g., interleukin (IL)-7, IL-15, or interferon-alpha (IFN-α)), a Toll-like receptor (TLR) agonist (e.g., a TLR 1/2 agonist (e.g., Pam3CSK4), a TLR3 agonist (e.g., Poly-ICLC), a TLR5 agonist (e.g., flagellin), a TLR7 agonist (e.g., GS-9620), or a TLR9 agonist (e.g., MGN1703 and CpG7909)), an immune checkpoint inhibitor (e.g., anti-PD-1 monoclonal antibody, an anti-PD-1 ligand (PD-L1) monoclonal antibody, or an anti-CTLA-4 monoclonal antibody), a histone deacetylase (HDAC) inhibitor (e.g., romidepsin, vorinostat, belinostat, LAQ824, panobinostat, entinostat, C1994, or mocetinostat), or a small molecule reservoir activator (e.g., disulfiram, a benzotriazole derivative (e.g., 3-Hydroxy-1,2,3-benzotriazin-4((3H)-one (HO-DHBt); a SMAC mimetic), or a BRG-Brahma Associated Factor (BAF) inhibitor (e.g., caffeic acid phenethyl ester or pyrimethamine)). In additional instances, the composition further includes an antiretroviral agent (ARV) (e.g., lamivudine and zidovudine, emtricitabine (FTC), zidovudine (ZDV), azidothymidine (AZT), lamivudine (3TC), zalcitabine, dideoxycytidine (ddC), tenofovir disoproxil fumarate (TDF), didanosine (ddI), stavudine (d4T), abacavir sulfate (ABC), etravirine, delavirdine (DLV), efavirenz (EFV), nevirapine (NVP), amprenavir (APV), tipranavir (TPV), indinavir (IDV), saquinavir, saquinavir mesylate (SQV), lopinavir (LPV), ritonavir (RTV), fosamprenavir calcium (FOS-APV), ritonavir, RTV, darunavir, atazanavir sulfate (ATV), nelfinavir mesylate (NFV), enfuvirtide, T-20, maraviroc, raltegravir, ibalizumab, IL-2, IL-12, or alpha-epibromide).

In some embodiments, the composition further includes one, two, three, or more different HIV-specific broadly neutralizing antibodies (bnAb), such as a CD4 binding site (CD4bs)-specific antibody (e.g., 3BNC117 or VRC07-523), a V2 glycan-dependent antibody (e.g., CAP256-VRC26), or PGT121 (see WO/2012/030904 incorporated herein by reference).

In some embodiments, the composition includes the antibody or antigen-binding fragment thereof in an amount of about 0.01-5000 mg (e.g., about 0.01-1000 mg, about 0.01-500 mg, about 0.05-500 mg, about 0.05-100 mg, about 0.1-100 mg, about 0.1-50 mg, 0.1-10 mg, or 1-10 mg). In some instances, the composition is formulated for subcutaneous, intramuscular, intradermal, transdermal, intranasal, or oral administration, or administration as an infusion (e.g., a continuous infusion or a bolus infusion). In some embodiments, the composition is formulated in a volume of about 1000 ml or less (e.g., 900 ml, 800 ml, 700 ml, 600 ml, 500 ml, 400 ml, 300 ml, 200 ml, 100 ml, 50 ml, 10 ml, 9 ml, 8 ml, 7 ml, 6 ml, 5 ml, 4 ml, 3 ml, 2 ml, or 1 ml, or a volume between about 0.1-1 ml (e.g., 0.2 ml, 0.3 ml, 0.4 ml, 0.5 ml, 0.6 ml, 0.7 ml, 0.8 ml, or 0.9 ml)).

Also featured is a method of treating or blocking an HIV infection in a subject by administering to the subject the antibody or antigen-binding fragment thereof, or a composition comprising the same. In some embodiments, the antibody or antigen-binding fragment thereof or the composition is administered to the subject in a dosage form, such as a dose of about 0.01-5000 mg (e.g., about 0.01-4000 mg, about 0.01-3000 mg, about 0.01-2000 mg, about 0.05-2000 mg, about 0.05-1000 mg, or about 0.1-1000 mg). In some instances, about 0.01-100 mg/kg (e.g., about 0.05-100 mg/kg, about 0.1-100 mg/kg, or about 0.5-40 mg/kg) of the antibody or antigen-binding fragment thereof is administered to the subject.

In some embodiments, the antibody or antigen-binding fragment thereof is administered to the subject two or more times. In some instances, the antibody or antigen-binding fragment thereof is administered to the subject one or more times daily, weekly, every two weeks, every three weeks, or monthly. In some embodiments, a single dose of the antibody or antigen-binding fragment thereof is administered to the subject. In different embodiments, more than one dose (e.g., a second dose) of the antibody or antigen-binding fragment thereof is administered to the subject (e.g., two weeks, three weeks, four weeks, or five weeks after administration of the first dose). In some embodiments, the antibody or antigen-binding fragment thereof is administered to the subject for at least one week, 2 weeks, 3 weeks, 1 month, 2 months, 6 months, 1 year, 2 years, or more. In some embodiments, administration of the antibody or antigen-binding fragment thereof reduces proviral DNA in a tissue (e.g., lymph node tissue, gastrointestinal tissue, and/or peripheral blood) of the subject relative to an untreated control, such as to below about 1,000 DNA copies/$10^6$ cells (e.g., below about 100 DNA copies/$10^6$ cells, below about 10 DNA copies/$10^6$ cells, below about 1 DNA copy/$10^6$ cells, or to an undetectable level). In some instances, following administration of the antibody or antigen-binding fragment thereof, the subject has a plasma viral load of less than 3,500 RNA copies/ml (e.g., less than 2,000 RNA copies/ml, less than 400 RNA copies/ml, less than 50 RNA copies/ml, or less than 1 RNA copy/ml), or an undetectable plasma viral load. In some instances, following administration of the antibody or antigen-binding fragment thereof, the subject has an undetectable plasma viral load for at least 2 months (e.g., at least 6 months, at least 1 year, or at least 5 years, or more). In some instances, the administration of the antibody or antigen-binding fragment thereof increases HIV-specific cell-mediated immune response and/or humoral immune response in the subject relative to an untreated control. In additional instances, administration of the antibody or antigen-binding fragment thereof decreases viral replication in the subject relative to an untreated control.

In some embodiments, the antibody or antigen-binding fragment thereof is administered intravenously, intramuscularly, intradermally, percutaneously, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctivally, intravesicularlly, mucosally, intrapericardially, intraumbilically, intraocularly, orally, topically, locally, by inhalation, by injection, by infusion, by continuous infusion, by localized perfusion bathing target cells directly, by catheter, by lavage, by gavage, in cremes, or in lipid compositions. In some instances, the antibody or antigen-binding fragment thereof is administered in combination with one or more immunomodulators (e.g., AS-101, Bropirimine, Acemannan, CL246,738, EL10, FP-21399, Gamma Interferon, Granulocyte Macrophage Colony Stimulating Factor, HIV Core Particle Immunostimulant, IL-2, Immune Globulin Intravenous, IMREG-1, IMREG-2, Imuthiol Diethyl Dithio Carbamate, Alpha-2 Interferon, Methionine-Enkephalin, MTP-PE Muramyl-Tripeptide, Granulocyte Colony Stimulating Factor, Remune, CD4 (e.g., recombinant soluble CD4), rCD4-IgG hybrids, SK&F106528 Soluble T4, Thymopentin, Tumor Necrosis Factor, or Infliximab. In added embodiments, the composition further includes at least one reservoir activator, such as a PKC agonist (e.g., a phorbol ester, a macrocyclic lactone such as bryostatin-1, or a diterpene such as an ingenol compound), a cytokine or chemokine (e.g., interleukin (IL)-7, IL-15, or interferon-alpha (IFN-α)), a Toll-like receptor (TLR) agonist (e.g., a TLR 1/2 agonist (e.g., Pam3CSK4), a TLR3 agonist (e.g., Poly-ICLC), a TLR5 agonist (e.g., flagellin), a TLR7 agonist (e.g., GS-9620), or a TLR9 agonist (e.g., MGN1703 and CpG7909)), an immune checkpoint inhibitor (e.g., anti-PD-1 monoclonal antibody, an anti-PD-1 ligand (PD-L1) monoclonal antibody, or an anti-CTLA-4 monoclonal antibody), a histone deacetylase (HDAC) inhibitor (e.g., romidepsin, vorinostat, belinostat, LAQ824, panobinostat, entinostat, C1994, or mocetinostat), or a small molecule reservoir activator (e.g., disulfiram, a benzotriazole derivative (e.g., 3-Hydroxy-1,2,3-benzotriazin-4((3H)-one (HO-DHBt); a SMAC mimetic), or a BRG-Brahma Associated Factor (BAF) inhibitor (e.g., caffeic acid phenethyl ester or pyrimethamine)). In additional instances, the composition further includes an antiretroviral agent (ARV) (e.g., lamivudine and zidovudine, emtricitabine (FTC), zidovudine (ZDV), azidothymidine (AZT), lamivudine (3TC), zalcitabine, dideoxycytidine (ddC), tenofovir disoproxil fumarate (TDF), didanosine (ddI), stavudine (d4T), abacavir sulfate (ABC), etravirine, delavirdine (DLV), efavirenz (EFV), nevirapine (NVP), amprenavir (APV), tipranavir (TPV), indinavir (IDV), saquinavir, saquinavir mesylate (SQV), lopinavir (LPV), ritonavir (RTV), fosamprenavir calcium (FOS-APV), ritonavir, RTV, darunavir, atazanavir sulfate (ATV), nelfinavir mesylate (NFV), enfuvirtide, T-20, maraviroc, raltegravir, ibalizumab, IL-2, IL-12, or alpha-epibromide). In some embodiments, the composition further includes one, two, three, or more different HIV-specific broadly neutralizing antibodies (bnAb), such as a CD4 binding site (CD4bs)-specific antibody (e.g., 3BNC117 or VRC07-523), a V2 glycan-dependent antibody (e.g., CAP256-VRC26), or PGT121. In some embodiments, the reservoir activator, the ARV, and/or the HIV-specific bnAb is/are administered prior to (e.g., 1 year, 9 months, 6 months, 3 months, 1 month, 3 weeks, 2 weeks, 1 week, 5 days, 3 days, 1 day, 18 hours, 12 hours, 6 hours, or 1 hour prior to), concurrently with and/or after (e.g., 1 year, 9 months, 6 months, 3 months, 1 month, 3 weeks, 2 weeks, 1 week, 5 days, 3 days, 1 day, 18 hours, 12 hours, 6 hours, or 1 hour after) the administration of the antibody or antigen-binding fragment thereof.

In some embodiments of the above aspect, the subject (e.g., a human) is infected with HIV (e.g., HIV type 1 (HIV-1) and/or HIV type 2 (HIV-2)), or is at risk of HIV transmission (e.g., a fetus of an HIV-infected pregnant female, a newborn having an HIV-infected mother, a subject having a needlestick injury, or a subject being sexually exposed to one or more HIV-infected individuals).

Definitions

As used herein, the term "about" refers to a value that is ±10% of the recited value.

As used herein, the term "antibody" refers to a molecule that specifically binds to, or is immunologically reactive with, a particular antigen and includes at least the variable domain of a heavy chain, and normally includes at least the variable domains of a heavy chain and of alight chain of an immunoglobulin. Antibodies and antigen-binding fragments, variants, or derivatives thereof include, but are not limited to, polyclonal, monoclonal, multispecific, human, humanized, primatized, or chimeric antibodies, heteroconjugate antibodies (e.g., bi- tri- and quad-specific antibodies, diabodies, triabodies, and tetrabodies), single-domain antibodies (sdAb), epitope-binding fragments, e.g., Fab, Fab' and F(ab')2, Fd, Fvs, single-chain Fvs (scFv), rIgG, single-chain antibodies, disulfide-linked Fvs (sdFv), fragments including either a $V_L$ or $V_H$ domain, fragments produced by an Fab expression library, and anti-idiotypic (anti-Id) antibodies. Antibody molecules of the invention can be of any type (e.g., IgG, IgE, IgM, IgD, IgA, and IgY), class (e.g., IgG1, IgG2, IgG3, IgG4, IgA1 and IgA2) or subclass of immunoglobulin molecule. Moreover, unless otherwise indicated, the term "monoclonal antibody" (mAb) is meant to include both intact molecules as well as antibody fragments (such as, for example, Fab and F (ab') 2 fragments) that are capable of specifically binding to a target protein. Fab and F (ab') 2 fragments lack the Fc fragment of an intact antibody.

The term "antigen-binding fragment," or "fragments" as used herein, refers to one or more fragments of an immunoglobulin that retain the ability to specifically bind to a target antigen. The antigen-binding function of an immunoglobulin can be performed by fragments of a full-length antibody. The antibody fragments can be a Fab, F(ab')2, scFv, SMIP, diabody, a triabody, an affibody, a nanobody, an aptamer, or a domain antibody. Examples of binding fragments encompassed by the term "antigen-binding fragment" of an antibody include, but are not limited to: (i) a Fab fragment, a monovalent fragment consisting of the $V_L$, $V_H$, $C_L$, and $C_H1$ domains; (ii) a F(ab')2 fragment, a bivalent fragment containing two Fab fragments linked by a disulfide bridge at the hinge region; (iii) a Fd fragment consisting of the $V_H$ and $C_H1$ domains; (iv) a Fv fragment consisting of the $V_L$ and $V_H$ domains of a single arm of an antibody, (v) a dAb (Ward et al., Nature 341:544-546, 1989) including $V_H$ and $V_L$ domains; (vi) a dAb fragment that consists of a $V_H$ domain; (vii) a dAb that consists of a $V_H$ or a $V_L$ domain; (viii) an isolated complementarity determining region (CDR); and (ix) a combination of two or more isolated CDRs which may optionally be joined by a synthetic linker. Furthermore, although the two domains of the Fv fragment, $V_L$ and $V_H$, are coded for by separate genes, they can be joined, using recombinant methods, by a linker that enables them to be made as a single protein chain in which the $V_L$ and $V_H$ regions pair to form monovalent molecules (known as single chain Fv (scFv)). These antibody fragments can be obtained using conventional techniques known to those of skill in the art, and the fragments can be screened for utility in the same manner as intact antibodies. Antigen-binding fragments can be produced by recombinant DNA techniques, enzymatic or chemical cleavage of intact immunoglobulins, or, in certain cases, by chemical peptide synthesis procedures known in the art.

The term "antibody-dependent cellular cytotoxicity" or "ADCC" refers to a form of cytotoxicity in which secreted Ig bound onto Fc receptors (FcRs) present on certain cytotoxic cells (e.g., Natural Killer (NK) cells, neutrophils, and macrophages) enable these cytotoxic effector cells to bind specifically to an antigen-bearing target cell and subsequently kill the target cell with cytotoxins. The antibodies "arm" the cytotoxic cells and facilitate cell killing functions. The primary cells for mediating ADCC, NK cells, express FcγRIII only, whereas monocytes express FcγRI, FcγRII, and FcγRIII. FcR expression on hematopoietic cells is summarized in Table 3 on page 464 of Ravetch and Kinet (Annu. Rev. Immunol. 9:457-92, 1991), incorporated herein by reference. To assess ADCC activity of a molecule of interest, an in vitro ADCC assay, such as that described in U.S. Pat. Nos. 5,500,362; 5,821,337; or 6,737,056, incorporated herein by reference, may be performed.

By "antiretroviral agent" or "ARV" is meant any of the therapeutic agents used to manage progression of a retrovirus (e.g., HIV) infection in a subject (e.g., a human), including, for example, nucleoside reverse transcriptase inhibitors (NRTIs), non-nucleoside reverse transcriptase inhibitors (NNRTIs), protease inhibitors (PIs), fusion inhibitors, entry inhibitors, maturation inhibitors, cellular inhibitors, integrase strand transfer inhibitors, and multi-class combinations. Such drugs include lamivudine and zidovudine, emtricitabine (FTC), zidovudine (ZDV), azidothymidine (AZT), lamivudine (3TC), zalcitabine, dideoxycytidine (ddC), tenofovir disoproxil fumarate (TDF), didanosine (ddl), stavudine (d4T), abacavir sulfate (ABC), etravirine, delavirdine (DLV), efavirenz (EFV), nevirapine (NVP), amprenavir (APV), tipranavir (TPV), indinavir (IDV), saquinavir, saquinavir mesylate (SQV), lopinavir (LPV), ritonavir (RTV), fosamprenavir calcium (FOS-APV), ritonavir, RTV, darunavir, atazanavir sulfate (ATV), nelfinavir mesylate (NFV), enfuvirtide, T-20, maraviroc and raltegravir. ART drugs can also include antibodies, such as ibalizumab, that target HIV proteins or cellular proteins associated with disease progression. Also included are immune-based therapeutic agents, such as IL-2, IL-12, and alpha-epibromide. Each of these drugs can be administered alone or in combination with any other ARV or any HIV-specific neutralizing antibody, such as a broadly neutralizing antibody, e.g., an N332 glycan-dependent antibody (e.g., PGT121 or one or more of the antibody variants, or a fragment thereof, described herein). "Antiretroviral therapy" or "ART" refers to the therapy that uses or involves administration of one or more of these ARVs.

By "reservoir activator" is meant an agent (e.g., a compound, complex, drug, protein, nucleic acid, or pharmaceutical composition) that has the effect of activating a viral reservoir (e.g., an HIV reservoir) or reversing viral latency (e.g., latency of HIV). Reservoir activators are also known in the art as latency reversing agents (LTAs). Examples of reservoir activators are disclosed in Spivak and Planelles (Annu Rev Med, 69:421-436, 2018), Stoszko et al (EBioMedicine, 3:108-121, 2016), and Delagreverie et al (Open Forum Infectious Diseases, DOI: 10.1093/ofid/ofw189);

incorporated herein by reference. Exemplary reservoir activators include PKC agonists, cytokines and chemokines, Toll-like receptor (TLR) agonists, immune checkpoint inhibitors, histone deacytelase (HDAC) inhibitors, and dedicated small molecule agents.

As used herein, by "blocking" a retroviral (e.g., human immunodeficiency virus (HIV) (e.g., HIV Type 1 or HIV Type 2)) infection in a subject (e.g., a human, including a human fetus, at risk of retroviral infection) is meant preventing or reducing retroviral establishment and propagation in the subject following exposure to HIV. Blocking an HIV infection may be, in some instances, a means of post-exposure prophylaxis (PEP).

By "broadly neutralizing antibody" or "bnAb," with respect to HIV (e.g., HIV-1), is meant an antibody that recognizes a specific antigen (e.g., gp120 of HIV) and inhibits the effect(s) of the antigen of at least 2, 3, 4, 5, 6, 7, 8, 9 or more different strains of HIV, the strains belonging to the same or different clades, in the host subject (e.g., human). As used herein, the antibody can be a single antibody or a plurality of antibodies.

By "CD4" or "cluster of differentiation 4" is meant an isolated, soluble, or cell surface-attached glycoprotein that is capable of binding and/or forming a complex with gp120. CD4 includes, for example, human CD4 protein (NCBI RefSeq No. NP_000607.1).

As used herein, by "CD4 binding site-specific antibody" or "CD4bs-specific antibody" is meant an antibody, or antibody fragment thereof, that specifically binds to gp120 of HIV (e.g., HIV Type 1 or HIV Type 2) at an epitope that overlaps partially or completely with that recognized by CD4, and/or that competes with CD4 for binding to gp120 of HIV. Examples of CD4bs-specific antibodies include 3BNC117 (Scheid et al., Nature. 458: 636-640, 2009), b12 (Roben et al., J Virol. 68: 4821-4828, 1994), and the other antibodies disclosed at Table 1 of U.S. Pub. No. 2012/0288502, which is incorporated herein by reference in its entirety.

As used herein, the term "clade" refers to related human immunodeficiency viruses (HIVs) classified according to their degree of genetic similarity. There are currently three groups of HIV-1 isolates: M, N and O. Group M (major strains) consists of at least ten clades, A through J. Group O (outer strains) may consist of a similar number of clades. Group N is a new HIV-1 isolate that has not been categorized in either group M or O. In certain exemplary embodiments, methods of the invention as described herein can be used to cure a subject (e.g., a human) infected with HIV (e.g., HIV-1) or to block HIV (e.g., HIV-1) infection in subject (e.g., a human) at risk of HIV transmission. The HIV may be of two, three, four, five, six, seven, eight, nine, ten, or more clades and/or two or more groups of HIV.

As used herein, the term "complementarity determining regions" or "CDRs" refers to the amino acid residues of an antibody variable domain that is involved in antigen binding. Each variable domain typically has three CDR regions identified as CDR-1, CDR-2 and CDR-3. Each complementarity determining region may comprise amino acid residues from a "complementarity determining region" as defined by Kabat (i.e., about residues 24-34 (CDR-L1), 50-56 (CDR-L2) and 89-97 (CDR-L3) in the light chain variable domain and 31-35 (CDR-H1), 50-65 (CDR-H2) and 95-102 (CDR-H3) in the heavy chain variable domain; Kabat et al. Sequences of Proteins of Immunological Interest, 5th Ed. Public Health Service, National Institutes of Health, Bethesda, Md. (1991)) and/or those residues from a "hypervariable loop" (i.e., about residues 26-32 (CDR-L1), 50-52 (CDR-L2) and 91-96 (CDR-L3) in the light chain variable domain and 26-32 (CDR-H1), 53-55 (CDR-H2) and 96-101 (CDR-H3) in the heavy chain variable domain; Chothia and Lesk, J. Mol. Biol. 196:901-917 (1987)). In some instances, a complementarity determining region can include amino acids from both a CDR region defined according to Kabat and a hypervariable loop.

Throughout this specification and claims, the word "comprise," or variations such as "comprises" or "with," will be understood to imply the inclusion of a stated integer or group of integers but not the exclusion of any other integer or group of integers.

As used herein, the term "envelope glycoprotein" refers, but is not limited to, the glycoprotein that is expressed on the surface of the envelope of HIV virions and the surface of the plasma membrane of HIV infected cells. The env gene encodes gp160, which is proteolytically cleaved into the gp120 and gp41 Envelope (Env) proteins. Gp120 binds to the CD4 receptor on a target cell that has such a receptor, such as, e.g., a T-helper cell. Gp41 is non-covalently bound to gp120, and provides the second step by which HIV enters the cell. It is originally buried within the viral envelope, but when gp120 binds to a CD4 receptor, gp120 changes its conformation causing gp41 to become exposed, where it can assist in fusion with the host cell.

The terms "human immunodeficiency virus" or "HIV," as used herein, refer generally to a retrovirus that is the causative agent for acquired immunodeficiency syndrome (AIDS), variants thereof, and diseases, conditions, or opportunistic infections associated with AIDS or its variants, and includes HIV-Type 1 (HIV-1) and HIV-Type 2 (HIV-2) of any clade or strain therein, related retroviruses, and variants thereof (e.g., engineered retroviruses, e.g., chimeric HIV viruses). Previous names for HIV include human T-lymphotropic virus-III (HTLV-III), lymphadenopathy-associated virus (LAV), and AIDS-associated retrovirus (ARV).

By "immunomodulator" is meant an agent, such as a protein or peptide, which is capable of increasing, inducing, or extending an immune response (e.g., a cell-mediated immune response and/or a humoral immune response) when administered to a subject (e.g., a human, e.g., a human infected with HIV or at risk of an HIV infection or transmission). Examples of immunomodulators include those disclosed at Table 1 of WO 01/38332, which is incorporated herein by reference in its entirety. An immunomodulator may be administered in conjunction with (e.g., prior to, concurrently with, or subsequent to, or within the context of a treatment regimen that includes the administration of an antibody or antigen-binding fragment thereof described herein (e.g., one or more of the PGT121 variant antibodies described herein).

As used herein, by "N332 glycan-dependent antibody" is meant an antibody, or antibody fragment thereof, that specifically binds to gp120 of HIV at residue N332 when the residue contains a glycan (e.g., HIV Type 1 or HIV Type 2) for specific recognition of HIV, and specifically includes PGT family antibodies (e.g., one or more of the PGT121 variant antibodies and fragments thereof described herein).

By "needlestick injury" is meant any wound of any size caused by a needle that intentionally or accidentally punctures the skin.

The term "plasma viral load," as used herein, means the amount of HIV in the circulating blood of a mammal, such as a human. The amount of HIV in the blood of a mammal can be determined by measuring the quantity of HIV RNA copies in the blood using methods known to those of ordinary skill in the art.

As used herein, by "PGT family antibody" is meant an antibody, or antibody fragment thereof, including PGT121, and PGT121 derivatives and clonal relatives thereof (e.g., antibody 10-1074), such as those disclosed in WO 2012/030904; WO 2013/055908; Walker et al. Nature. 477: 466-470, 2011; Mouquet et al. *Proc. Natl. Acad. Sci.* 109(47): E3268-E3277, 2012; Julien et al., *PLoS Pathog.* 9: e1003342, 2013; and Kong et al., *Nat. Struc. Mol. Biol.* 20: 796-803, 2013, which are incorporated herein by reference in their entirety.

By "pharmaceutical composition" is meant a composition containing a compound described herein (e.g., one or more of the PGT121 variant antibodies described herein) that can be formulated, for example, for oral administration in unit dosage form (e.g., a tablet, capsule, caplet, gelcap, or syrup); for topical administration (e.g., as a cream, gel, lotion, or ointment); for intravenous administration (e.g., as a sterile solution free of particulate emboli and in a solvent system suitable for intravenous use); or in any other formulation described herein.

A "pharmaceutically acceptable carrier" is meant a carrier which is physiologically acceptable to a mammal (e.g., a human) while retaining the therapeutic properties of the compound (e.g., one or more of the PGT121 variant antibodies described herein) with which it is administered. One exemplary pharmaceutically acceptable carrier is physiological saline. Other physiologically acceptable carriers and their formulations are known to one skilled in the art and described, for example, in *Remington's Pharmaceutical Sciences* (18th edition, A. Gennaro, 1990, Mack Publishing Company, Easton, Pa.), incorporated herein by reference.

By "proviral DNA" is meant viral (e.g., retroviral, e.g., HIV, e.g., HIV-1) genomic DNA that is integrated into the DNA of a host cell, such as a tissue cell (e.g., a lymph node, gastrointestinal, or peripheral blood tissue cell).

As used herein, the term "reduce" with respect to proviral DNA level in tissue of a subject refers to a decrease of proviral DNA level by 5%, 10%, 15%, 20%, 25%, 30%, 35%, 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more in a subject administered an N332 glycan-dependent antibody (e.g., one or more of the PGT121 variant antibodies described herein) compared to that of a control subject (e.g., a subject not administered one or more of the PGT121 variant antibodies described herein) or a subject administered a placebo). Administration of one or more of the PGT121 variant antibodies described herein, or a fragment thereof, may, for example, result in a decrease in proviral DNA level in tissue to below about 1,000 DNA copies/$10^6$ cells (e.g., below about 100 DNA copies/$10^6$ cells, e.g., below about 10 DNA copies/$10^6$ cells, e.g., below about 1 DNA copy/$10^6$ cells).

The term "retrovirus," as used herein, refers to a virus belonging to the viral family Retroviridae, which includes viruses that possess an RNA genome, and that replicate via a DNA intermediate.

By "sequence identity" or "sequence similarity" is meant that the identity or similarity between two or more amino acid sequences, or two or more nucleotide sequences, is expressed in terms of the identity or similarity between the sequences. Sequence identity can be measured in terms of percentage identity; the higher the percentage, the more identical the sequences are. Sequence similarity can be measured in terms of percentage similarity (which takes into account conservative amino acid substitutions); the higher the percentage, the more similar the sequences are. Homologs or orthologs of nucleic acid or amino acid sequences possess a relatively high degree of sequence identity/similarity when aligned using standard methods.

Methods of alignment of sequences for comparison are well known in the art. Various programs and alignment algorithms are described in: Smith & Waterman, *Adv. Appl. Math.* 2:482, 1981; Needleman & Wunsch, *J. Mol. Biol.* 48:443, 1970; Pearson & Lipman, *Proc. Natl. Acad. Sci. USA* 85:2444, 1988; Higgins & Sharp, *Gene,* 73:237-44, 1988; Higgins & Sharp, *CABIOS* 5:151-3, 1989; Corpet et al., *Nuc. Acids Res.* 16:10881-90, 1988; Huang et al. *Computer Appls. in the Biosciences* 8, 155-65, 1992; and Pearson et al., *Meth. Mol. Bio.* 24:307-31, 1994. Altschul et al., *J. Mol. Biol.* 215:403-10, 1990, presents a detailed consideration of sequence alignment methods and homology calculations.

The NCBI Basic Local Alignment Search Tool (BLAST) (Altschul et al., *J. Mol. Biol.* 215:403-10, 1990) is available from several sources, including the National Center for Biological Information (NCBI, National Library of Medicine, Building 38A, Room 8N805, Bethesda, Md. 20894) and on the Internet, for use in connection with the sequence analysis programs blastp, blastn, blastx, tblastn and tblastx. These software programs match similar sequences by assigning degrees of homology to various substitutions, deletions, and other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. Additional information can be found at the NCBI web site.

BLASTN is used to compare nucleic acid sequences, while BLASTP is used to compare amino acid sequences. To compare two nucleic acid sequences, the options can be set as follows: -i is set to a file containing the first nucleic acid sequence to be compared (such as C:\seq1.txt); -j is set to a file containing the second nucleic acid sequence to be compared (such as C:\seq2.txt); -p is set to blastn; -o is set to any desired file name (such as C:\output.txt); -q is set to −1; -r is set to 2; and all other options are left at their default setting. For example, the following command can be used to generate an output file containing a comparison between two sequences: C:\B12seq -i c:\seq1.txt -j c:\seq2.txt -p blastn -o c:\output.txt -q -1 -r 2.

To compare two amino acid sequences, the options of B12seq can be set as follows: -i is set to a file containing the first amino acid sequence to be compared (such as C:\\.txt); -j is set to a file containing the second amino acid sequence to be compared (such as C:\seq2.txt); -p is set to blastp; -o is set to any desired file name (such as C:\output.txt); and all other options are left at their default setting. For example, the following command can be used to generate an output file containing a comparison between two amino acid sequences: C:\B12seq -i c:\seq1.txt -j c:\seq2.txt -p blastp -o c:\output.txt. If the two compared sequences share homology, then the designated output file will present those regions of homology as aligned sequences. If the two compared sequences do not share homology, then the designated output file will not present aligned sequences.

Once aligned, the number of matches is determined by counting the number of positions where an identical amino acid or nucleotide residue is presented in both sequences. The percent sequence identity is determined by dividing the number of matches either by the length of the sequence set forth in the identified sequence, or by an articulated length (such as 100 consecutive nucleotides or amino acid residues from a sequence set forth in an identified sequence), followed by multiplying the resulting value by 100. For polypeptides, the length of comparison sequences will generally be at least 5, 6, 7, 8, 9, 10, 11, 12, 13, 14, 15, 16, 17, 18, 19, 20, 25, 50, 75, 90, 100, 110, 120, 130, 140, or 150 or more contiguous amino acids.

By "specifically binds" is meant the preferential association of an antibody, or fragment thereof, to a target molecule (e.g., a viral protein, e.g., gp120, e.g., a region of gp120 containing N332 with a glycan) in a sample (e.g., a biological sample) or in vivo or ex vivo. It is recognized that a certain degree of non-specific interaction may occur between an antibody and a non-target molecule. Nevertheless, specific binding may be distinguished as mediated through specific recognition of the target molecule. Specific binding results in a stronger association between the antibody, or fragment thereof, and, e.g., an antigen (e.g., gp120, e.g., the N332 glycan of gp120) than between the antibody and, e.g., a non-target molecule (e.g., non-viral polypeptide). In one example, the antibody may specifically bind to the N332 glycan of envelope glycoprotein gp120 of HIV. In another example, the antibody may specifically bind to the CD4 binding site (CD4bs) of envelope glycoprotein gp120 of HIV. The antibody (e.g., one or more of the PGT121 variant antibodies described herein) may have, e.g., at least 2-fold greater affinity (e.g., 2, 3, 4, 5, 6, 7, 8, 9, 10, $10^2$-, $10^3$-, $10^4$-, $10^5$-, $10^6$, $10^7$-, $10^8$-, $10^9$-, or $10^{10}$-fold greater affinity) to the gp120 protein than to other viral or non-viral polypeptides (e.g., one or more of the PGT121 variant antibodies described herein has at least 2-fold greater affinity to gp120 than a comparable IgG antibody).

A "subject" is a mammal, such as a human. Mammals also include, but are not limited to, primates (e.g., monkeys, e.g., rhesus monkeys) farm animals (e.g., cows), sport animals (e.g., horses), pets (e.g., cats and dogs), mice, rats, rabbits, and guinea pigs.

As used herein, and as well understood in the art, "treatment" is an approach for obtaining beneficial or desired results, such as clinical results. Beneficial or desired results can include, but are not limited to, cure or eradication of disease, disorder, or condition (e.g., HIV infection); alleviation or amelioration of one or more symptoms or conditions (e.g., HIV infection); diminishment of extent of disease, disorder, or condition (e.g., HIV infection); stabilization (i.e., not worsening) of a state of disease, disorder, or condition (e.g., HIV infection); prevention or reduction of spread or transmission of disease, disorder, or condition (e.g., HIV infection); delay or slowing the progress of the disease (e.g., by 1 month, 2 months, 3 months, 4 months, 5 months, 6 months, 7 months, 8 months, 9 months, 10 months, 11 months, 1 year, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, or more), disorder, or condition (e.g., HIV infection); amelioration or palliation of the disease, disorder, or condition (e.g., HIV infection); and remission (whether partial or total), whether detectable or undetectable (e.g., undetectable for a length of time, such as for over 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, or more).

As used herein, by "treating" a subject (e.g., a human) infected with a retrovirus (e.g., HIV-1 or HIV-2) is meant obtaining and maintaining virologic control, e.g., in the absence of an ART, for a period of at least 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, or more.

As used herein, "storage stability" refers to the stability of a compound, such as a protein (e.g., an antibody, such as one or more of the PGT121 variant antibodies or antigen-binding fragments thereof described herein) over extended periods. Therapeutic proteins (e.g., therapeutic antibodies) with storage stability have longer shelf lives and are resistant to degradation over time. Proteins (e.g., antibodies) in solution can degrade by means of several mechanisms during extended storage, and a common degradation route is aggregation of the protein over time. Storage stability is a factor in determining pharmaceutical success of therapeutic proteins antibodies (e.g., therapeutic antibodies). Hence, biopharmaceutical developers aim to create liquid biopharmaceutical formulations (e.g., liquid formulations of antibodies) with long shelf lives and resistance to the formation of aggregates. Proteins (e.g., antibodies) with storage stability are resistant to aggregation over time (e.g., over 2 days, 3 days, 4 days, 5 days, 6 days, 1 week, 2 weeks, 3 weeks, 1 month, 2 months, 3 months, 4 months, 5 months, 6 months, 1 year, 2 years, 3 years, 4 years, 5 years, or more at a temperature of about −40° C. to 50° C. (e.g., about −40° C., −35° C., −30° C., −25° C., −20° C., −15° C., −10° C., −5° C., 0° C., 5° C., 10° C., 15° C., 20° C., 25° C., 30° C., 35° C., 40° C., 45° C., or 50° C.)), and, thus, are suitable for extended storage and safe therapeutic application.

As used herein, "manufacturability" refers to ease of manufacture of proteins (e.g., therapeutic proteins such as antibodies) is determined by design and biophysical properties of the protein that contribute to easy and successful manufacture of the same. Manufacturability of protein (e.g., antibody) is determined by stability at low pH, intramolecular stability, thermodynamic stability, and resistance to aggregation. Proteins (e.g., therapeutic proteins such as antibodies) are exposed to a wide range of non-physiological processes and conditions during production (including variations of temperature, pH, protein concentrations, ionic strength, exposure to air-water interfaces and mechanical stress) that can dramatically increase their propensity to aggregate. Resistance to aggregation and/or reduced aggregation of proteins ensures ease of manufacture or manufacturability. Thus, successful production of a protein therapeutic (e.g., antibodies) requires balancing the potency and pharmacokinetics of the candidate therapeutic with its manufacturing capability or manufacturability.

As used herein, "variable domain" of an antibody, or fragment thereof, refers to the portions of the light and heavy chains of antibody molecules that include amino acid sequences of complementarity determining regions (CDRs; i.e., CDR-1, CDR-2, and CDR-3, e.g., CDR-H1, CDR-H2, CDR-H3, CDR-L1, CDR-L2, and CDR-L3), and surrounding framework regions (FRs). $V_H$ refers to the variable domain of the heavy chain. $V_L$ refers to the variable domain of the light chain. The amino acid residues assigned to CDRs are defined according to Kabat (Sequences of Proteins of Immunological Interest, 5th Ed. Public Health Service, National Institutes of Health, Bethesda, Md. (1991)). Amino acid numbering of antibodies or antigen binding fragments is also according to that of Kabat.

As used herein, the term "virologic control" is meant a condition characterized by undetectable proviral DNA level in tissue (e.g., lymph node tissue, gastrointestinal tissue, and/or peripheral blood), such as below about 1,000 DNA copies/$10^6$ cells (e.g., below about 100 DNA copies/$10^6$ cells, e.g., below about 10 DNA copies/$10^6$ cells, e.g., below about 1 DNA copy/$10^6$ cells), and/or undetectable plasma viral load, such as less than 3,500 RNA copies/ml (e.g., less than 2,000 RNA copies/ml, e.g., less than 400 RNA copies/ml, e.g., less than 50 RNA copies/ml, e.g., less than 1 RNA copy/ml).

The term "virus," as used herein, is defined as an infectious agent that is unable to grow or reproduce outside a host cell (e.g., a mammalian cell) and that infects an animal (e.g., a mammal, such as a human).

BRIEF DESCRIPTION OF DRAWINGS

FIGS. 2A-2C are tables showing the neutralization properties of the Round-1 PGT121 variant antibodies against pseudoviruses of human immunodeficiency virus (HIV).

FIG. 5 is a table showing biophysical properties of the Round-2 PGT121 variant antibodies.

Figure 6A:
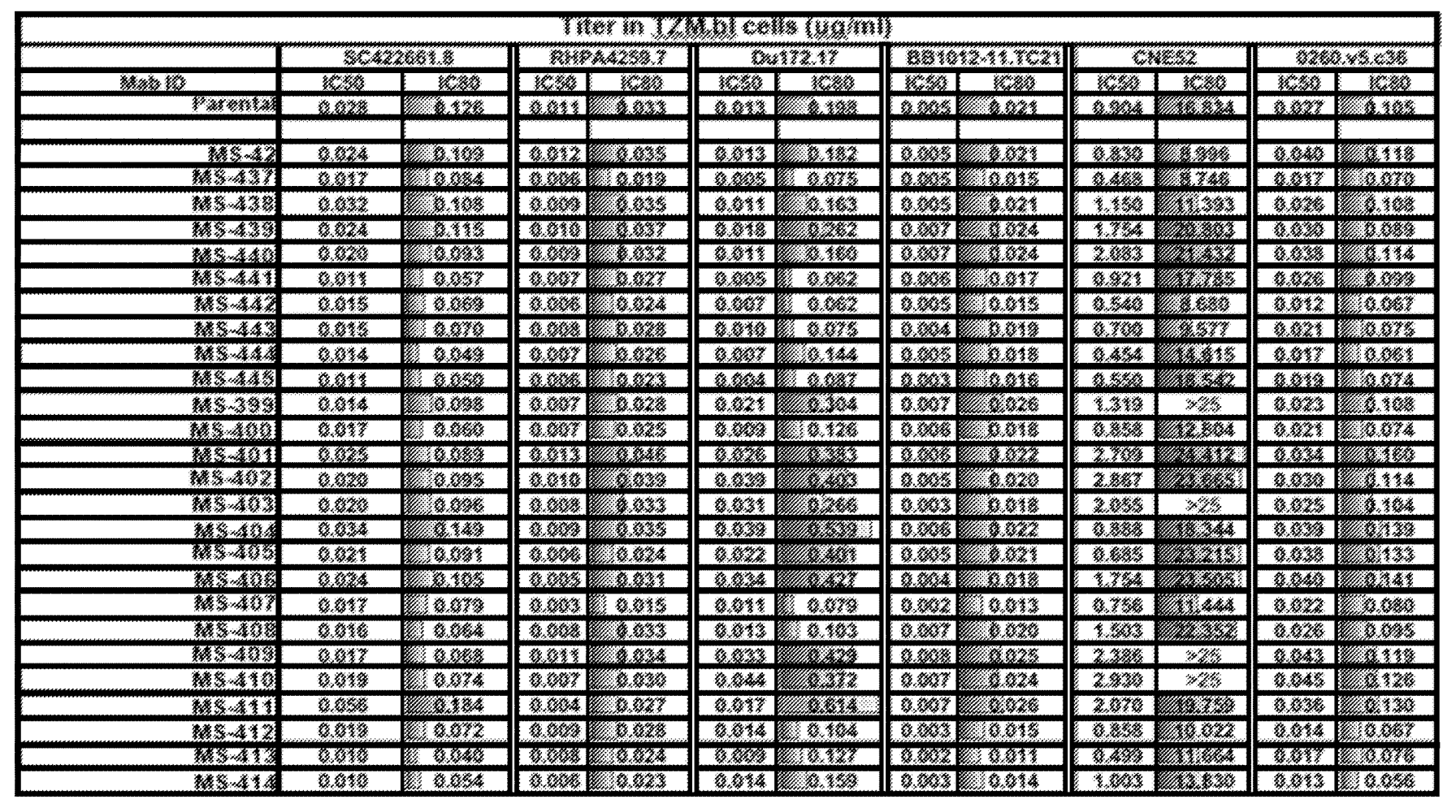
Figure 6B:
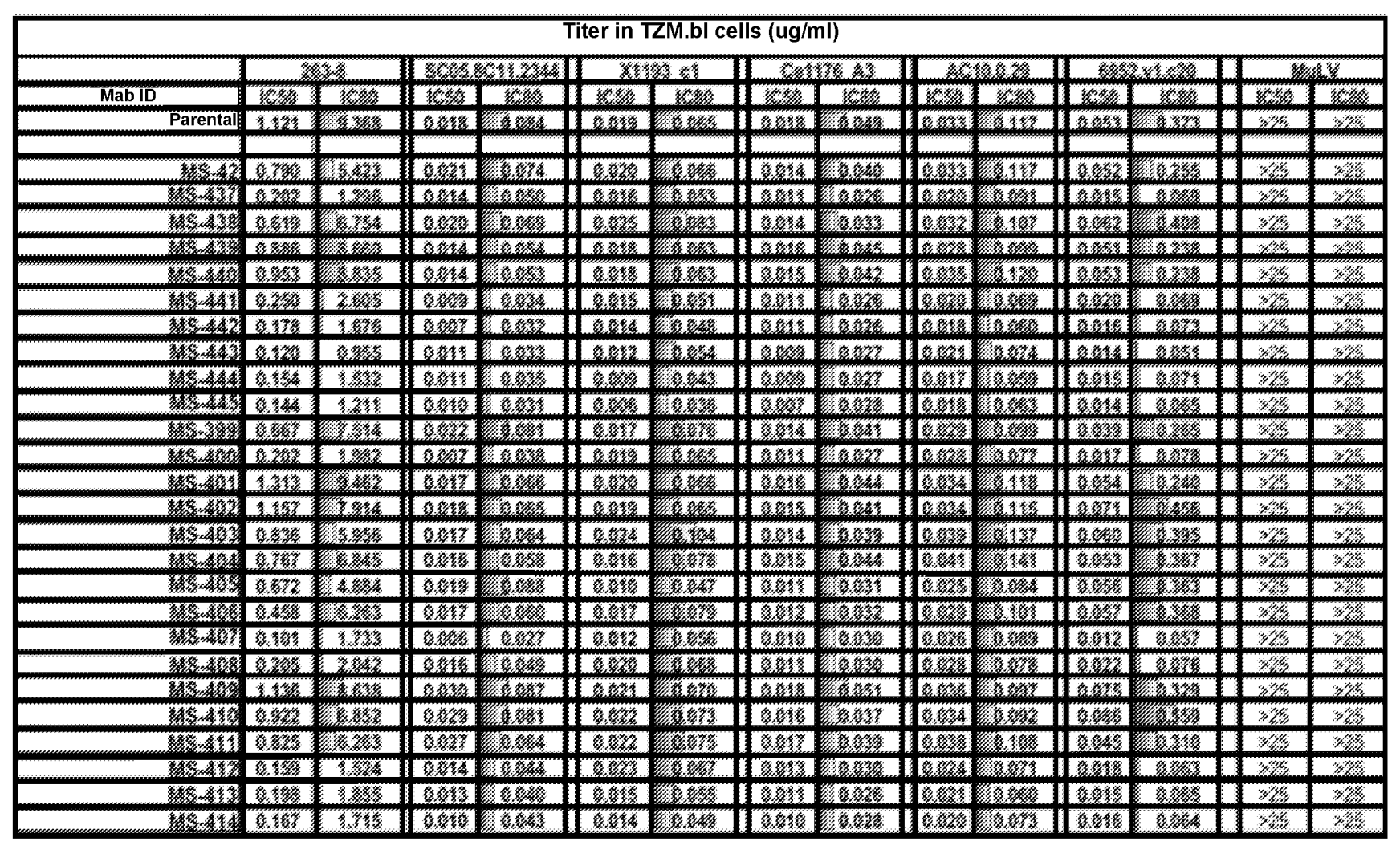

FIGS. 6A and 6B are tables showing the neutralization properties of the Round-2 PGT121 variant antibodies against pseudoviruses of HIV. Dark bars indicate IC80 values less than that of the parental antibody.

Figure 1:
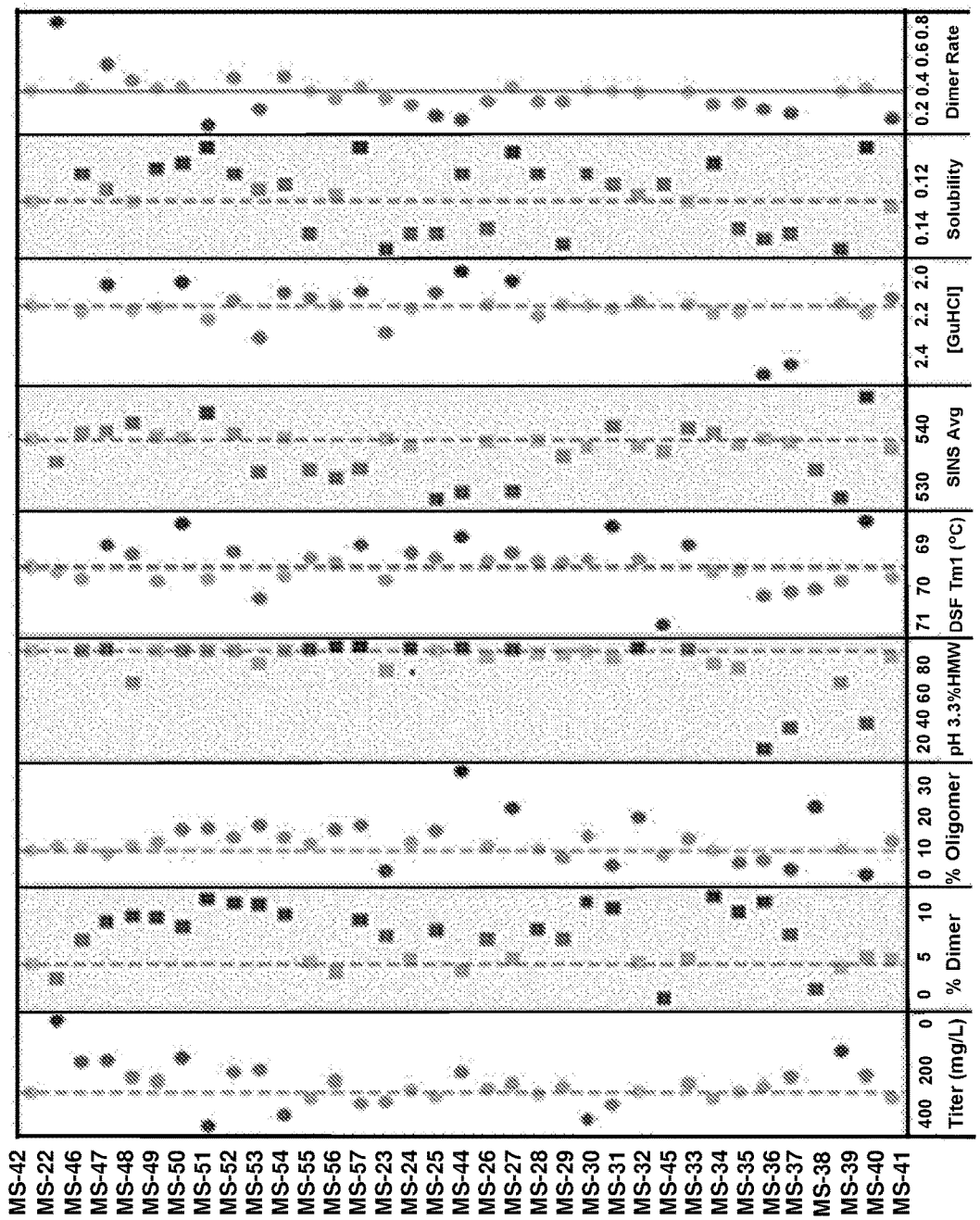
FIG. 1 is a table outlining the analysis of biophysical properties of the Round-1 PGT121 variant antibodies. Solubility represents % PEG; dimer rate represents % high molecular weight (HMW) content/week. The vertical line in each column separates points falling within a desirable range (left side) and a non-desirable range (right side) of values for the biophysical property represented in the respective column. Shading of the points is lightest on the vertical line and darkens as the points move to the left or right of the line (i.e., the shading darkens with increasingly desirable or non-desirable values). Circles and squares are used alternatively to distinguish points between the columns.
Figure 3A:
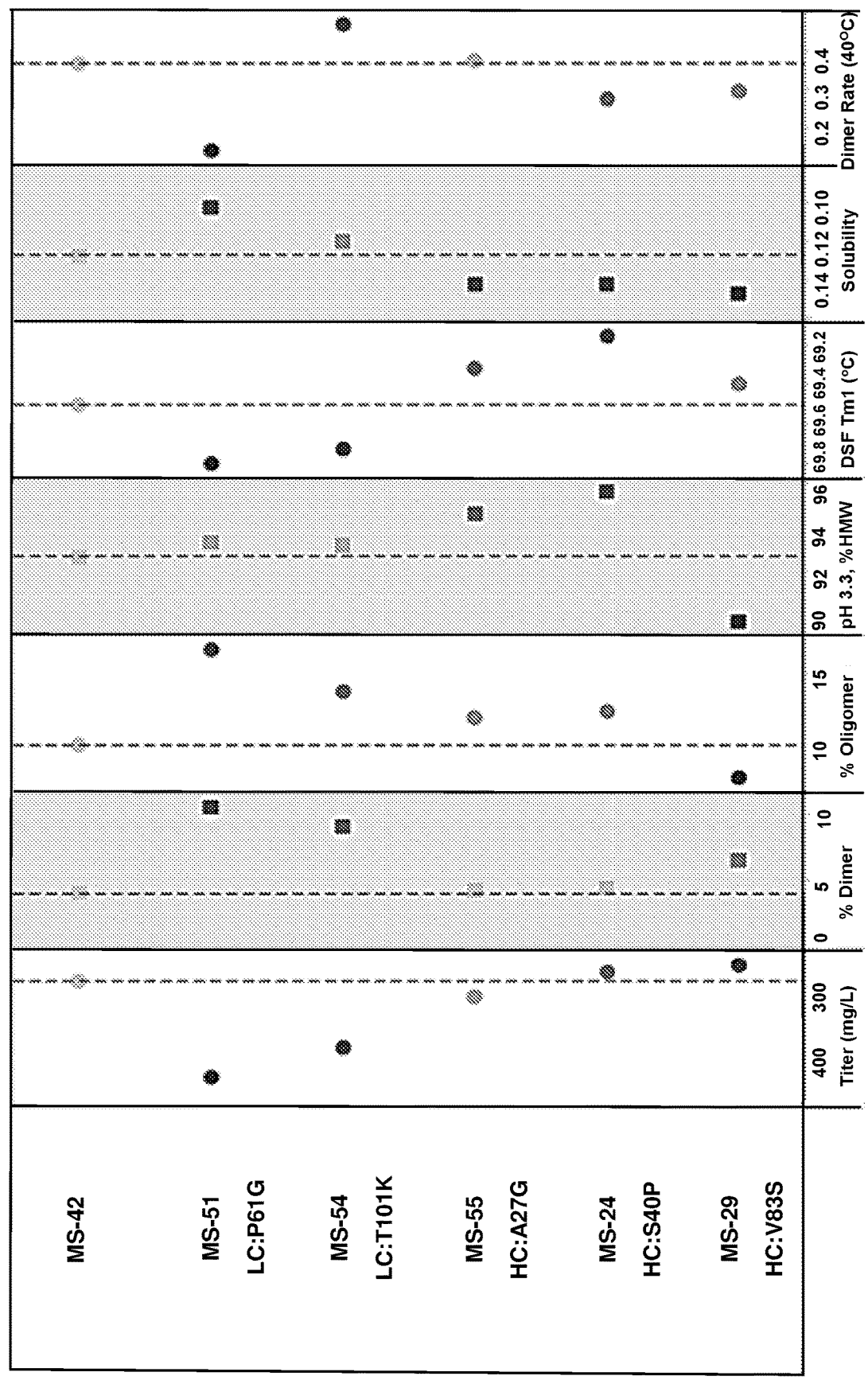
FIG. 3A is a graph showing biophysical characteristics of PGT121 variant antibodies with the indicated amino acid residue modification, which was used to produce combinatorial PGT121 variant antibodies.
Figure 3B:
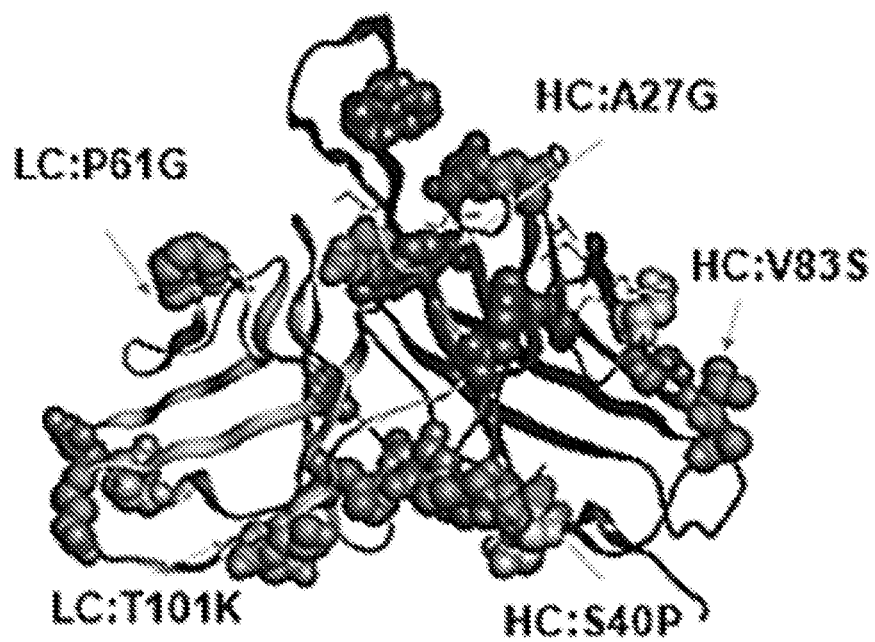
FIG. 3B is a schematic showing the residues used for producing combinatorial PGT121 variant antibodies.
Figure 4:
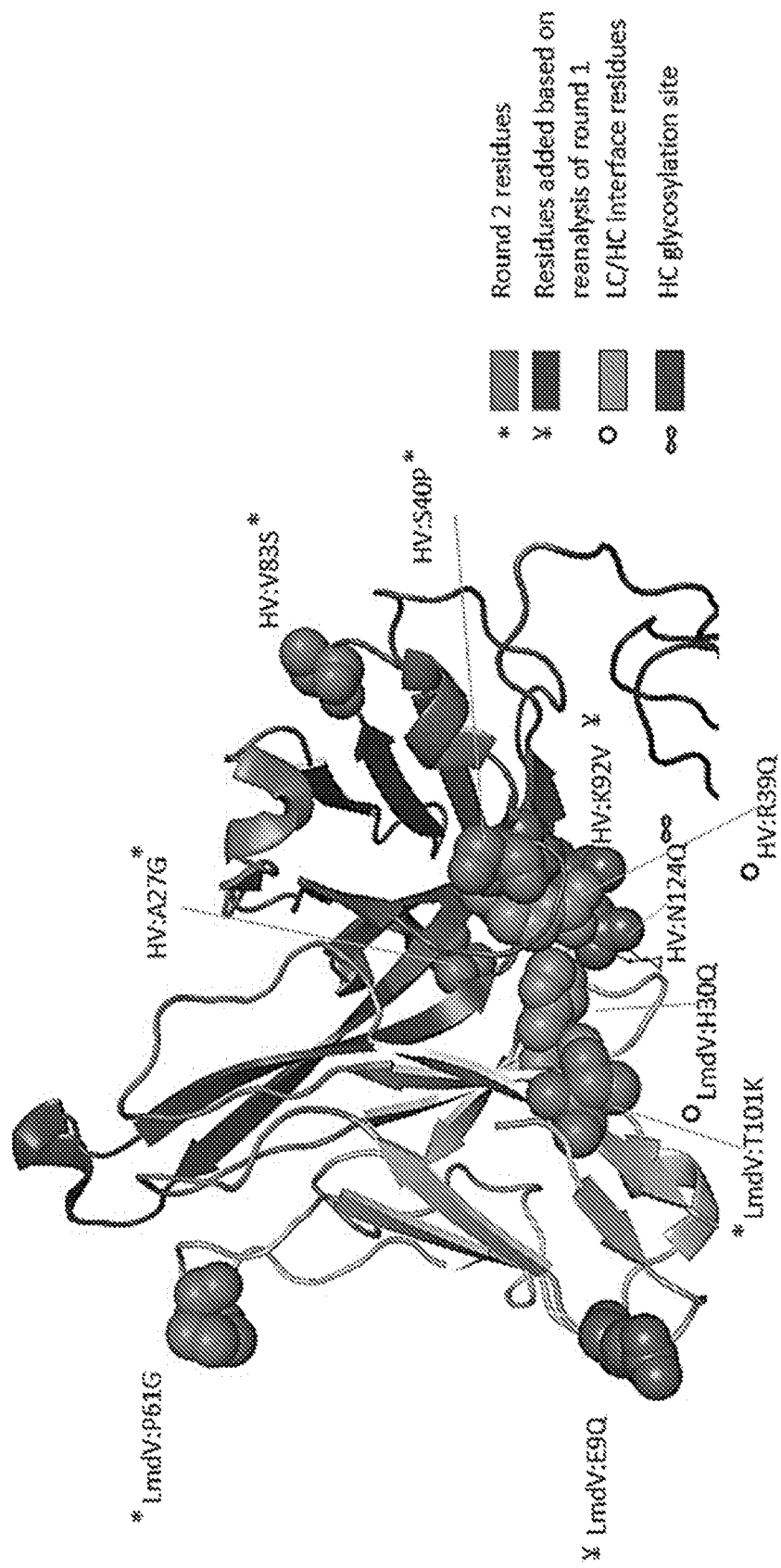
FIG. 4 is a schematic showing the amino acid combinations of the Round-2 PGT121 variant antibodies.

Other features and advantages of the invention will be apparent from the following Detailed Description and the claims.

DETAILED DESCRIPTION OF THE INVENTION

We have identified and mutated potentially destabilizing residues in the variable domain (Fv) of the PGT121 antibody. These residues of the antibody, by themselves or in combination, may lead to instability at low pH, increased susceptibility to chemical degradation, or aggregation during production or long term storage. Based on our discovery, we generated a series of antibody variants with mutations of one or more of the destabilizing residues. The antibody variants produced by such combinatorial residue replacement techniques retained potency (e.g., viral inactivation or neutralization potency) while exhibiting desired biophysical characteristics, in particular, increased stability at low pH, reduced susceptibility to chemical degradation, and reduced aggregation. Featured herein are PGT121 variant antibodies and antigen-binding fragments thereof that retain the ability of the native PGT121 antibody to inactivate or neutralize viruses (e.g., HIV-1), while showing significant improvement in production efficiency (e.g., increased production titer), manufacturability, and storage stability relative to the native PGT121 antibody.

I. Antibodies and Antigen-Binding Fragments Thereof

Featured are PGT121 variant antibodies and antigen-binding fragments thereof that exhibit improved properties. The PGT121 variant antibodies or fragment thereof contains: (i) a heavy chain variable domain having a sequence with at least 90% (e.g., at least 91%, at least 92%, at least 93%, at least 94%, at least 95%, at least 96%, at least 97%, at least 98%, at least 99%, or 100%) sequence identity to SEQ ID NO: 1393, and at least one (e.g., at least one, at least two, at least three, at least four, at least five, at least six, at least seven, at least eight, at least nine, or more) of the following mutations in the heavy chain variable domain: A27G, D31 E, D31S, R39Q, S40P, D56E, D56S, N68T, V78F, S81K, V83S, A84S, K92V, and N124Q; and/or (ii) a light chain variable domain having a sequence with at least 90% (e.g., at least 91%, at least 92%, at least 93%, at least 94%, at least 95%, at least 96%, at least 97%, at least 98%, at least 99%, or 100%) sequence identity to SEQ ID NO: 1394, and at least one (e.g., at least one, at least two, at least three, at least four, at least five, at least six, at least seven, at least eight, at least nine, or more) of the following mutations in the light chain variable domain: S1P, D2S, E9Q, H30Q, S37V, P58S, P61G, S72G, D87E, and T101K.

For example, the PGT121 variant antibody or fragment thereof may contain (i) a heavy chain variable domain having a sequence with at least 90% sequence identity to SEQ ID NO: 1393, and at least one (e.g., at least one, at least two, at least three, at least four, at least five, at least six, at least seven, at least eight, at least nine, or more) of the following mutations in the heavy chain variable domain: A27G, D31E, D31S, R39Q, S40P, D56E, D56S, N68T, V78F, S81K, V83S, A84S, K92V, and N124Q; and (ii) a light chain variable domain having a sequence with at least 90% sequence identity to SEQ ID NO: 1394. Alternatively, the PGT121 variant antibody or fragment thereof may contain (i) a heavy chain variable domain having a sequence with at least 90% sequence identity to SEQ ID NO: 1393; and (ii) a light chain variable domain having a sequence with at least 90% sequence identity to SEQ ID NO: 1394, and at least one (e.g., at least one, at least two, at least three, at least four, at least five, at least six, at least seven, at least eight, at least nine, or more) of the following mutations in the light chain variable domain: S1P, D2S, E9Q, H30Q, S37V, P58S, P61G, S72G, D87E, and T101K. In other embodiments, PGT121 variant antibody or fragment thereof may have (i) a heavy chain variable domain having a sequence with at least 90% sequence identity to SEQ ID NO: 1393; (ii) a light chain variable domain having a sequence with at least 90% sequence identity to SEQ ID NO: 1394; (iii) at least one (e.g., at least one, at least two, at least three, at least four, at least five, at least six, at least seven, at least eight, at least nine, or more) of the following mutations in the heavy chain variable domain: A27G, D31E, D31S, R39Q, S40P, D56E, D56S, N68T, V78F, S81K, V83S, A84S, K92V, and N124Q; and (iv) at least one (e.g., at least one, at least two, at least three, at least four, at least five, at least six, at least seven, at least eight, at least nine, or more) of the following mutations in the light chain variable domain: S1P, D2S, E9Q, H30Q, S37V, P58S, P61G, S72G, D87E, and T101K.

In some embodiments, the heavy chain variable domain of the antibody or antigen-binding fragment thereof may have at least one (e.g., at least one, at least two, at least three, at least four, at least five, at least six, at least seven, at least eight, at least nine, or more) amino acid modification(s) (e.g., an insertion, deletion, or substitution) in the framework region relative to the amino acid sequence of SEQ ID NO: 1393. Additionally, or alternatively, the heavy chain variable domain of the antibody or antigen-binding fragment thereof may have at least one (e.g., at least one, at least two, at least three, at least four, at least five, at least six, at least seven, at least eight, at least nine, or more) amino acid modification(s) (e.g., an insertion, deletion, or substitution) in the heavy chain (HC) complementarity determining region (CDR) (such as, HC-CDR1, HC-CDR2, and/or HC-CDR3) relative to the amino acid sequence of SEQ ID NO: 1393. In other embodiments, the light chain variable domain of the antibody or antigen-binding fragment thereof may have at least one (e.g., at least one, at least two, at least three, at least four, at least five, at least six, at least seven, at least eight, at least nine, or more) amino acid modification(s) (e.g., an insertion, deletion, or substitution) in the framework region relative to the amino acid sequence of SEQ ID NO: 1394. Additionally, or alternatively, the light chain variable domain of the antibody or antigen-binding fragment thereof may have at least one (e.g., at least one, at least two, at least three, at least four, at least five, at least six, at least seven, at least eight, at least nine, or more) amino acid modification(s) (e.g., an insertion, deletion, or substitution) in the light chain (LC) CDR (such as, LC-CDR1, LC-CDR2, and/or LC-CDR3) relative to the amino acid sequence of SEQ ID NO: 1394.

In some embodiments, the PGT121 variant antibody or fragment thereof may have (i) a heavy chain variable domain having a sequence with at least 90% sequence identity to SEQ ID NO: 1393; (ii) a light chain variable domain having a sequence with at least 90% sequence identity to SEQ ID NO: 1394; (iii) a R39Q mutation in the heavy chain variable domain; and (iv) a H30Q mutation in the light chain variable domain. Such a PGT121 variant antibody or fragment thereof may further comprise: at least one (e.g., at least one, at least two, at least three, at least four, at least five, at least six, at least seven, at least eight, at least nine, or more) of the following mutations in the heavy chain variable domain: A27G, D31E, D31S, S40P, D56E, D56S, N68T, V78F, S81K, V83S, A84S, K92V, and N124Q; and/or at least one (e.g., at least one, at least two, at least three, at least four, at least five, at least six, at least seven, at least eight, at least nine, or more) of the following mutations in the light chain variable domain: S1P, D2S, E9Q, S37V, P58S, P61G, S72G, D87E, and T101K.

The Fc domain of any of the PGT121 variant antibodies or fragments thereof described herein may include the sequence of SEQ ID NO: 1401, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1401. Alternatively, the Fc domain of any of the PGT121 variant antibodies or fragments thereof described herein may include the sequence of SEQ ID NO: 1402, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1402. Preferentially, the Fc domain of the PGT121 variant antibody or fragment thereof includes the sequence of SEQ ID NO: 1402, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1402. Alternatively, the Fc domain of the PGT121 variant antibody or fragment thereof may include a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1401, and a M87L and/or a N93S mutation. The Fc domain of any of the PGT121 variant antibodies or fragments thereof described herein may further include the sequence of SEQ ID NO: 1403, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1403. Together, the Fc domain of any of the PGT121 variant antibodies or fragments thereof described herein may have: (i) the sequence of SEQ ID NO: 1404, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1404; or (ii) the sequence of SEQ ID NO: 1405, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1405.

The featured PGT121 variant antibody or fragment thereof may further include an Ig domain with the sequence of SEQ ID NO: 1406, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1406. Additionally, the antibody or antigen-binding fragment thereof described herein may further include a Hinge region with the sequence of SEQ ID NO: 1407, or a sequence with at least 85% (e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%) sequence identity to SEQ ID NO: 1407.

In specific embodiments:

(a) a PGT121 variant antibody or fragment thereof featured herein includes (i) the following six complementarity determining regions (CDRs): a heavy chain (HC)-CDR1 with the amino acid sequence of SEQ ID NO: 12, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 12; a HC-CDR2 with the amino acid sequence of SEQ ID NO: 14, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 14; a HC-CDR3 with the amino acid sequence of SEQ ID NO: 16, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 16; a light chain (LC)-CDR1 with the amino acid sequence of SEQ ID NO: 4, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 4; a LC-CDR2 with the amino acid sequence of SEQ ID NO: 6, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 6; and a LC-CDR3 with the amino acid sequence of SEQ ID NO: 8, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 8; and/or (ii) a heavy chain variable domain having amino acids 20-481 of SEQ ID NO: 10, and a light chain variable domain having amino acids 20-230 of SEQ ID NO: 2. In some embodiments, the heavy chain variable domain may have HC-CDR1, HC-CDR2, and HC-CDR3 with the amino acid sequence of SEQ ID NOs: 12, 14, and 16, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 10. In some embodiments, the light chain variable domain may have LC-CDR1, LC-CDR2, and LC-CDR3 with the amino acid sequence of SEQ ID NOs: 4, 6, and 8, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 2. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 11, 13, 15, 3, 5, 7, 9, and 1, respectively;

(b) a PGT121 variant antibody or fragment thereof featured herein includes (i) the following six complementarity determining regions (CDRs): a heavy chain (HC)-CDR1 with the amino acid sequence of SEQ ID NO: 28, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 28; a HC-CDR2 with the amino acid sequence of SEQ ID NO: 30, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 30; a HC-CDR3 with the amino acid sequence of SEQ ID NO: 32, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 32; a light chain (LC)-CDR1 with the amino acid sequence of SEQ ID NO: 20, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 20; a LC-CDR2 with the amino acid sequence of SEQ ID NO: 22, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 22; and a LC-CDR3 with the amino acid sequence of SEQ ID NO: 24, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 24; and/or (ii) a heavy chain variable domain having amino acids 20-481 of SEQ ID NO: 26, and alight chain variable domain having amino acids 20-230 of SEQ ID NO: 18; the antibody or antigen-binding fragment thereof has a S1P mutation in the light chain variable domain. In some embodiments, the heavy chain variable domain may have HC-CDR1, HC-CDR2, and HC-CDR3 with the amino acid sequence of SEQ ID NOs: 28, 30, and 32, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 26. In some embodiments, the light chain variable domain may have LC-CDR1, LC-CDR2, and LC-CDR3 with the amino acid sequence of SEQ ID NOs: 20, 22, and 24, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 18. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 27, 29, 31, 19, 21, 23, 25, and 17, respectively;

(c) a PGT121 variant antibody or fragment thereof featured herein includes the following six complementarity determining regions (CDRs): a heavy chain (HC)-CDR1 with the amino acid sequence of SEQ ID NO: 44, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 44; a HC-CDR2 with the amino acid sequence of SEQ ID NO: 46, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 46; a HC-CDR3 with the amino acid sequence of SEQ ID NO: 48, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 48; a light chain (LC)-CDR1 with the amino acid sequence of SEQ ID NO: 36, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 36; a LC-CDR2 with the amino acid sequence of SEQ ID NO: 38, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 38; and a LC-CDR3 with the amino acid sequence of SEQ ID NO: 40, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 40; and/or (ii) a heavy chain variable domain having amino acids 20-481 of SEQ ID NO: 42, and a light chain variable domain having amino acids 20-230 of SEQ ID NO: 34; the antibody or antigen-binding fragment thereof has a D2S mutation in the light chain variable domain. In some embodiments, the heavy chain variable domain may have HC-CDR1, HC-CDR2, and HC-CDR3 with the amino acid sequence of SEQ ID NOs: 44, 46, and 48, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 42. In some embodiments, the light chain variable domain may have LC-CDR1, LC-CDR2, and LC-CDR3 with the amino acid sequence of SEQ ID NOs: 36, 38, and 40, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 34. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 43, 45, 47, 35, 37, 39, 41, and 33, respectively;

(d) a PGT121 variant antibody or fragment thereof featured herein includes (i) the following six complementarity determining regions (CDRs): a heavy chain (HC)-CDR1 with the amino acid sequence of SEQ ID NO: 60, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 60; a HC-CDR2 with the amino acid sequence of SEQ ID NO: 62, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 62; a HC-CDR3 with the amino acid sequence of SEQ ID NO: 64, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 64; a light chain (LC)-CDR1 with the amino acid sequence of SEQ ID NO: 52, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 52; a LC-CDR2 with the amino acid sequence of SEQ ID NO: 54, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 54; and a LC-CDR3 with the amino acid sequence of SEQ ID NO: 56, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 56; and (ii) a heavy chain variable domain having amino acids 20-481 of SEQ ID NO: 58, and a light chain variable domain having amino acids 20-230 of SEQ ID NO: 50; the antibody or antigen-binding fragment thereof has a E9Q mutation in the light chain variable domain. In some embodiments, the heavy chain variable domain may have HC-CDR1, HC-CDR2, and HC-CDR3 with the amino acid sequence of SEQ ID NOs: 60, 62, and 64, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 58. In some embodiments, the light chain variable domain may have LC-CDR1, LC-CDR2, and LC-CDR3 with the amino acid sequence of SEQ ID NOs: 52, 54, and 56, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 50. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 59, 61, 63, 51, 53, 55, 57, and 49, respectively;

(e) a PGT121 variant antibody or fragment thereof featured herein includes (i) the following six complementarity determining regions (CDRs): a heavy chain (HC)-CDR1 with the amino acid sequence of SEQ ID NO: 76, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 76; a HC-CDR2 with the amino acid sequence of SEQ ID NO: 78, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 78; a HC-CDR3 with the amino acid sequence of SEQ ID NO: 80, or 10 or fewer (e.g., 9, 8, 7, 6, 5, 4, 3, 2 or 1) amino acid modification (s) (e.g., insertion, deletion, or substitution) relative to the amino acid sequence of SEQ ID NO: 80; a light chain (LC)-CDR1 with the amino acid sequence of SEQ ID NO: 68, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 68; a LC-CDR2 with the amino acid sequence of SEQ ID NO: 70, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 70; and a LC-CDR3 with the amino acid sequence of SEQ ID NO: 72, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 72; and/or (ii) a heavy chain variable domain having amino acids 20-481 of SEQ ID NO: 74, and a light chain variable domain having amino acids 20-230 of SEQ ID NO: 66; the antibody or antigen-binding fragment thereof has a H30Q mutation in the light chain variable domain. In some embodiments, the heavy chain variable domain may have HC-CDR1, HC-CDR2, and HC-CDR3 with the amino acid sequence of SEQ ID NOs: 76, 78, and 80, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 74. In some embodiments, the light chain variable domain may have LC-CDR1, LC-CDR2, and LC-CDR3 with the amino acid sequence of SEQ ID NOs: 68, 70, and 72, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 66. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 75, 77, 79, 67, 69, 71, 73, and 65, respectively;

(f) a PGT121 variant antibody or fragment thereof featured herein includes (i) the following six complementarity determining regions (CDRs): a heavy chain (HC)-CDR1 with the amino acid sequence of SEQ ID NO: 92, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 92; a HC-CDR2 with the amino acid sequence of SEQ ID NO: 94, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 94; a HC-CDR3 with the amino acid sequence of SEQ ID NO: 96, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 96; a light chain (LC)-CDR1 with the amino acid sequence of SEQ ID NO: 84, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 84; a LC-CDR2 with the amino acid sequence of SEQ ID NO: 86, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 86; and a LC-CDR3 with the amino acid sequence of SEQ ID NO: 88, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 88; and/or (ii) a heavy chain variable domain having amino acids 20-481 of SEQ ID NO: 90, and a light chain variable domain having amino acids 20-230 of SEQ ID NO: 82; the antibody or antigen-binding fragment thereof has a S37V mutation in the light chain variable domain. In some embodiments, the heavy chain variable domain may have HC-CDR1, HC-CDR2, and HC-CDR3 with the amino acid sequence of SEQ ID NOs: 92, 94, and 96, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 90. In some embodiments, the light chain variable domain may have LC-CDR1, LC-CDR2, and LC-CDR3 with the amino acid sequence of SEQ ID NOs: 84, 86, and 88, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 82. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 91, 93, 95, 83, 85, 87, 89, and 81, respectively;

(g) a PGT121 variant antibody or fragment thereof featured herein includes (i) the following six complementarity determining regions (CDRs): a heavy chain (HC)-CDR1 with the amino acid sequence of SEQ ID NO: 108, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 108; a HC-CDR2 with the amino acid sequence of SEQ ID NO: 110, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 110; a HC-CDR3 with the amino acid sequence of SEQ ID NO: 112, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 112; a light chain (LC)-CDR1 with the amino acid sequence of SEQ ID NO: 100, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 100; a LC-CDR2 with the amino acid sequence of SEQ ID NO: 102, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 102; and a LC-CDR3 with the amino acid sequence of SEQ ID NO: 104, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 104; and/or (ii) a heavy chain variable domain having amino acids 20-481 of SEQ ID NO: 106, and a light chain variable domain having amino acids 20-230 of SEQ ID NO: 98; the antibody or antigen-binding fragment thereof has a P58S mutation in the light chain variable domain. In some embodiments, the heavy chain variable domain may have HC-CDR1, HC-CDR2, and HC-CDR3 with the amino acid sequence of SEQ ID NOs: 108, 110, and 112, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 106. In some embodiments, the light chain variable domain may have LC-CDR1, LC-CDR2, and LC-CDR3 with the amino acid sequence of SEQ ID NOs: 100, 102, and 104, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 98. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 107, 109, 111, 99, 101, 103, 105, and 97, respectively;

(h) a PGT121 variant antibody or fragment thereof featured herein includes (i) the following six complementarity determining regions (CDRs): a heavy chain (HC)-CDR1 with the amino acid sequence of SEQ ID NO: 124, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 124; a HC-CDR2 with the amino acid sequence of SEQ ID NO: 126, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 126; a HC-CDR3 with the amino acid sequence of SEQ ID NO: 128, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 128; a light chain (LC)-CDR1 with the amino acid sequence of SEQ ID NO: 116, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 116; a LC-CDR2 with the amino acid sequence of SEQ ID NO: 118, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 118; and a LC-CDR3 with the amino acid sequence of SEQ ID NO: 120, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 120; and/or (ii) a heavy chain variable domain having amino acids 20-481 of SEQ ID NO: 122, and a light chain variable domain having amino acids 20-230 of SEQ ID NO: 114; the antibody or antigen-binding fragment thereof has a P61G mutation in the light chain variable domain. In some embodiments, the heavy chain variable domain may have HC-CDR1, HC-CDR2, and HC-CDR3 with the amino acid sequence of SEQ ID NOs: 124, 126, and 128, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 122. In some embodiments, the light chain variable domain may have LC-CDR1, LC-CDR2, and LC-CDR3 with the amino acid sequence of SEQ ID NOs: 116, 118, and 120, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 114. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 123, 125, 127, 115, 117, 119, 121, and 113, respectively;

(i) a PGT121 variant antibody or fragment thereof featured herein includes (i) the following six complementarity determining regions (CDRs): a heavy chain (HC)-CDR1 with the amino acid sequence of SEQ ID NO: 140, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 140; a HC-CDR2 with the amino acid sequence of SEQ ID NO: 142, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 142; a HC-CDR3 with the amino acid sequence of SEQ ID NO: 144, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 144; a light chain (LC)-CDR1 with the amino acid sequence of SEQ ID NO: 132, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 132; a LC-CDR2 with the amino acid sequence of SEQ ID NO: 134, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 134; and a LC-CDR3 with the amino acid sequence of SEQ ID NO: 136, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 136; and/or (ii) a heavy chain variable domain having amino acids 20-481 of SEQ ID NO: 138, and a light chain variable domain having amino acids 20-230 of SEQ ID NO: 130; the antibody or antigen-binding fragment thereof has a S72G mutation in the light chain variable domain. In some embodiments, the heavy chain variable domain may have HC-CDR1, HC-CDR2, and HC-CDR3 with the amino acid sequence of SEQ ID NOs: 140, 142, and 144, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 138. In some embodiments, the light chain variable domain may have LC-CDR1, LC-CDR2, and LC-CDR3 with the amino acid sequence of SEQ ID NOs: 132, 134, and 136, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 130. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 139, 141, 143, 131, 133, 135, 137, and 129, respectively;

(j) a PGT121 variant antibody or fragment thereof featured herein includes (i) the following six complementarity determining regions (CDRs): a heavy chain (HC)-CDR1 with the amino acid sequence of SEQ ID NO: 156, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 156; a HC-CDR2 with the amino acid sequence of SEQ ID NO: 158, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 158; a HC-CDR3 with the amino acid sequence of SEQ ID NO: 160, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 160; a light chain (LC)-CDR1 with the amino acid sequence of SEQ ID NO: 148, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 148; a LC-CDR2 with the amino acid sequence of SEQ ID NO: 150, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 150; and a LC-CDR3 with the amino acid sequence of SEQ ID NO: 152, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 152; and/or (ii) a heavy chain variable domain having amino acids 20-481 of SEQ ID NO: 154, and a light chain variable domain having amino acids 20-230 of SEQ ID NO: 146; the antibody or antigen-binding fragment thereof has a D87E mutation in the light chain variable domain. In some embodiments, the heavy chain variable domain may have HC-CDR1, HC-CDR2, and HC-CDR3 with the amino acid sequence of SEQ ID NOs: 156, 158, and 160, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 154. In some embodiments, the light chain variable domain may have LC-CDR1, LC-CDR2, and LC-CDR3 with the amino acid sequence of SEQ ID NOs: 148, 150, and 152, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 146. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 155, 157, 159, 147, 149, 151, 153, and 145, respectively;

(k) a PGT121 variant antibody or fragment thereof featured herein includes (i) the following six complementarity determining regions (CDRs): a heavy chain (HC)-CDR1 with the amino acid sequence of SEQ ID NO: 172, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 172; a HC-CDR2 with the amino acid sequence of SEQ ID NO: 174, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 174; a HC-CDR3 with the amino acid sequence of SEQ ID NO: 176, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 176; a light chain (LC)-CDR1 with the amino acid sequence of SEQ ID NO: 164, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 164; a LC-CDR2 with the amino acid sequence of SEQ ID NO: 166, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 166; and a LC-CDR3 with the amino acid sequence of SEQ ID NO: 168, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 168; and/or (ii) a heavy chain variable domain having amino acids 20-481 of SEQ ID NO: 170, and a light chain variable domain having amino acids 20-230 of SEQ ID NO: 162; the antibody or antigen-binding fragment thereof has a T101K mutation in the light chain variable domain. In some embodiments, the heavy chain variable domain may have HC-CDR1, HC-CDR2, and HC-CDR3 with the amino acid sequence of SEQ ID NOs: 172, 174, and 176, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 170. In some embodiments, the light chain variable domain may have LC-CDR1, LC-CDR2, and LC-CDR3 with the amino acid sequence of SEQ ID NOs: 164, 166, and 168, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 162. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 171, 173, 175, 163, 165, 167, 169, and 161, respectively;

(l) a PGT121 variant antibody or fragment thereof featured herein includes (i) the following six complementarity determining regions (CDRs): a heavy chain (HC)-CDR1 with the amino acid sequence of SEQ ID NO: 188, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 188; a HC-CDR2 with the amino acid sequence of SEQ ID NO: 190, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 190; a HC-CDR3 with the amino acid sequence of SEQ ID NO: 192, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 192; a light chain (LC)-CDR1 with the amino acid sequence of SEQ ID NO: 180, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 180; a LC-CDR2 with the amino acid sequence of SEQ ID NO: 182, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 182; and a LC-CDR3 with the amino acid sequence of SEQ ID NO: 184, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 184; and/or (ii) a heavy chain variable domain having amino acids 20-481 of SEQ ID NO: 186, and a light chain variable domain having amino acids 20-230 of SEQ ID NO: 178; the antibody or antigen-binding fragment thereof has a A27G mutation in the heavy chain variable domain. In some embodiments, the heavy chain variable domain may have HC-CDR1, HC-CDR2, and HC-CDR3 with the amino acid sequence of SEQ ID NOs: 188, 190, and 192, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 186. In some embodiments, the light chain variable domain may have LC-CDR1, LC-CDR2, and LC-CDR3 with the amino acid sequence of SEQ ID NOs: 180, 182, and 184, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 178. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 187, 189, 191, 179, 181, 183, 185, and 177, respectively;

(m) a PGT121 variant antibody or fragment thereof featured herein includes (i) the following six complementarity determining regions (CDRs): a heavy chain (HC)-CDR1 with the amino acid sequence of SEQ ID NO: 204, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 204; a HC-CDR2 with the amino acid sequence of SEQ ID NO: 206, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 206; a HC-CDR3 with the amino acid sequence of SEQ ID NO: 208, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 208; a light chain (LC)-CDR1 with the amino acid sequence of SEQ ID NO: 196, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 196; a LC-CDR2 with the amino acid sequence of SEQ ID NO: 198, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 198; and a LC-CDR3 with the amino acid sequence of SEQ ID NO: 200, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 200; and/or (ii) a heavy chain variable domain having amino acids 20-481 of SEQ ID NO: 202, and a light chain variable domain having amino acids 20-230 of SEQ ID NO: 194; the antibody or antigen-binding fragment thereof has a D31E mutation in the heavy chain variable domain. In some embodiments, the heavy chain variable domain may have HC-CDR1, HC-CDR2, and HC-CDR3 with the amino acid sequence of SEQ ID NOs: 204, 206, and 208, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 202. In some embodiments, the light chain variable domain may have LC-CDR1, LC-CDR2, and LC-CDR3 with the amino acid sequence of SEQ ID NOs: 196, 198, and 200, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 194. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 203, 205, 207, 195, 197, 199, 201, and 193, respectively;

(n) a PGT121 variant antibody or fragment thereof featured herein includes (i) the following six complementarity determining regions (CDRs): a heavy chain (HC)-CDR1 with the amino acid sequence of SEQ ID NO: 220, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 220; a HC-CDR2 with the amino acid sequence of SEQ ID NO: 222, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 222; a HC-CDR3 with the amino acid sequence of SEQ ID NO: 224, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 224; a light chain (LC)-CDR1 with the amino acid sequence of SEQ ID NO: 212, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 212; a LC-CDR2 with the amino acid sequence of SEQ ID NO: 214, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 214; and a LC-CDR3 with the amino acid sequence of SEQ ID NO: 216, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 216; and/or (ii) a heavy chain variable domain having amino acids 20-481 of SEQ ID NO: 218, and a light chain variable domain having amino acids 20-230 of SEQ ID NO: 210; the antibody or antigen-binding fragment thereof has a D31S mutation in the heavy chain variable domain. In some embodiments, the heavy chain variable domain may have HC-CDR1, HC-CDR2, and HC-CDR3 with the amino acid sequence of SEQ ID NOs: 220, 222, and 224, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 218. In some embodiments, the light chain variable domain may have LC-CDR1, LC-CDR2, and LC-CDR3 with the amino acid sequence of SEQ ID NOs: 212, 214, and 216, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 210. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 219, 221, 223, 211, 213, 215, 217, and 209, respectively;

(o) a PGT121 variant antibody or fragment thereof featured herein includes (i) the following six complementarity determining regions (CDRs): a heavy chain (HC)-CDR1 with the amino acid sequence of SEQ ID NO: 236, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 236; a HC-CDR2 with the amino acid sequence of SEQ ID NO: 238, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 238; a HC-CDR3 with the amino acid sequence of SEQ ID NO: 240, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 240; a light chain (LC)-CDR1 with the amino acid sequence of SEQ ID NO: 228, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 228; a LC-CDR2 with the amino acid sequence of SEQ ID NO: 230, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 230; and a LC-CDR3 with the amino acid sequence of SEQ ID NO: 232, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 232; and/or (ii) a heavy chain variable domain having amino acids 20-481 of SEQ ID NO: 234, and a light chain variable domain having amino acids 20-230 of SEQ ID NO: 226; the antibody or antigen-binding fragment thereof has a R39Q mutation in the heavy chain variable domain. In some embodiments, the heavy chain variable domain may have HC-CDR1, HC-CDR2, and HC-CDR3 with the amino acid sequence of SEQ ID NOs: 236, 238, and 240, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 234. In some embodiments, the light chain variable domain may have LC-CDR1, LC-CDR2, and LC-CDR3 with the amino acid sequence of SEQ ID NOs: 228, 230, and 232, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 226. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 235, 237, 239, 227, 229, 231, 233, and 225, respectively;

(p) a PGT121 variant antibody or fragment thereof featured herein includes (i) the following six complementarity determining regions (CDRs): a heavy chain (HC)-CDR1 with the amino acid sequence of SEQ ID NO: 252, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 252; a HC-CDR2 with the amino acid sequence of SEQ ID NO: 254, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 254; a HC-CDR3 with the amino acid sequence of SEQ ID NO: 256, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 256; a light chain (LC)-CDR1 with the amino acid sequence of SEQ ID NO: 244, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 244; a LC-CDR2 with the amino acid sequence of SEQ ID NO: 246, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 246; and a LC-CDR3 with the amino acid sequence of SEQ ID NO: 248, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 248; and/or (ii) a heavy chain variable domain having amino acids 20-481 of SEQ ID NO: 250, and a light chain variable domain having amino acids 20-230 of SEQ ID NO: 242; the antibody or antigen-binding fragment thereof has a S40P mutation in the heavy chain variable domain. In some embodiments, the heavy chain variable domain may have HC-CDR1, HC-CDR2, and HC-CDR3 with the amino acid sequence of SEQ ID NOs: 252, 254, and 256, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 250. In some embodiments, the light chain variable domain may have LC-CDR1, LC-CDR2, and LC-CDR3 with the amino acid sequence of SEQ ID NOs: 244, 246, and 248, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 242. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 251, 253, 255, 243, 245, 247, 249, and 241, respectively;

(q) a PGT121 variant antibody or fragment thereof featured herein includes (i) the following six complementarity determining regions (CDRs): a heavy chain (HC)-CDR1 with the amino acid sequence of SEQ ID NO: 268, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 268; a HC-CDR2 with the amino acid sequence of SEQ ID NO: 270, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 270; a HC-CDR3 with the amino acid sequence of SEQ ID NO: 272, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 272; a light chain (LC)-CDR1 with the amino acid sequence of SEQ ID NO: 260, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 260; a LC-CDR2 with the amino acid sequence of SEQ ID NO: 262, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 262; and a LC-CDR3 with the amino acid sequence of SEQ ID NO: 264, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 264; and/or (ii) a heavy chain variable domain having amino acids 20-481 of SEQ ID NO: 266, and a light chain variable domain having amino acids 20-230 of SEQ ID NO: 258; the antibody or antigen-binding fragment thereof has a D56E mutation in the heavy chain variable domain. In some embodiments, the heavy chain variable domain may have HC-CDR1, HC-CDR2, and HC-CDR3 with the amino acid sequence of SEQ ID NOs: 268, 270, and 272, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 266. In some embodiments, the light chain variable domain may have LC-CDR1, LC-CDR2, and LC-CDR3 with the amino acid sequence of SEQ ID NOs: 260, 262, and 264, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 258. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 267, 269, 271, 259, 261, 263, 265, and 257, respectively;

(r) a PGT121 variant antibody or fragment thereof featured herein includes (i) the following six complementarity determining regions (CDRs): a heavy chain (HC)-CDR1 with the amino acid sequence of SEQ ID NO: 284, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 284; a HC-CDR2 with the amino acid sequence of SEQ ID NO: 286, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 286; a HC-CDR3 with the amino acid sequence of SEQ ID NO: 288, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 288; a light chain (LC)-CDR1 with the amino acid sequence of SEQ ID NO: 276, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 276; a LC-CDR2 with the amino acid sequence of SEQ ID NO: 278, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 278; and a LC-CDR3 with the amino acid sequence of SEQ ID NO: 280, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 280; and/or (ii) a heavy chain variable domain having amino acids 20-481 of SEQ ID NO: 282, and a light chain variable domain having amino acids 20-230 of SEQ ID NO: 274; the antibody or antigen-binding fragment thereof has a D56S mutation in the heavy chain variable domain. In some embodiments, the heavy chain variable domain may have HC-CDR1, HC-CDR2, and HC-CDR3 with the amino acid sequence of SEQ ID NOs: 284, 286, and 288, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 282. In some embodiments, the light chain variable domain may have LC-CDR1, LC-CDR2, and LC-CDR3 with the amino acid sequence of SEQ ID NOs: 276, 278, and 280, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 274. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 283, 285, 287, 275, 277, 279, 281, and 273, respectively;

(s) a PGT121 variant antibody or fragment thereof featured herein includes (i) the following six complementarity determining regions (CDRs): a heavy chain (HC)-CDR1 with the amino acid sequence of SEQ ID NO: 300, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 300; a HC-CDR2 with the amino acid sequence of SEQ ID NO: 302, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 302; a HC-CDR3 with the amino acid sequence of SEQ ID NO: 304, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 304; a light chain (LC)-CDR1 with the amino acid sequence of SEQ ID NO: 292, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 292; a LC-CDR2 with the amino acid sequence of SEQ ID NO: 294, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 294; and a LC-CDR3 with the amino acid sequence of SEQ ID NO: 296, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 296; and/or (ii) a heavy chain variable domain having amino acids 20-481 of SEQ ID NO: 298, and a light chain variable domain having amino acids 20-230 of SEQ ID NO: 290; the antibody or antigen-binding fragment thereof has a N68T mutation in the heavy chain variable domain. In some embodiments, the heavy chain variable domain may have HC-CDR1, HC-CDR2, and HC-CDR3 with the amino acid sequence of SEQ ID NOs: 300, 302, and 304, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 298. In some embodiments, the light chain variable domain may have LC-CDR1, LC-CDR2, and LC-CDR3 with the amino acid sequence of SEQ ID NOs: 292, 294, and 296, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 290. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 299, 301, 303, 291, 293, 295, 297, and 289, respectively;

(t) a PGT121 variant antibody or fragment thereof featured herein includes (i) the following six complementarity determining regions (CDRs): a heavy chain (HC)-CDR1 with the amino acid sequence of SEQ ID NO: 316, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 316; a HC-CDR2 with the amino acid sequence of SEQ ID NO: 318, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 318; a HC-CDR3 with the amino acid sequence of SEQ ID NO: 320, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 320; a light chain (LC)-CDR1 with the amino acid sequence of SEQ ID NO: 308, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 308; a LC-CDR2 with the amino acid sequence of SEQ ID NO: 310, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 310; and a LC-CDR3 with the amino acid sequence of SEQ ID NO: 312, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 312; and/or (ii) a heavy chain variable domain having amino acids 20-481 of SEQ ID NO: 314, and a light chain variable domain having amino acids 20-230 of SEQ ID NO: 306; the antibody or antigen-binding fragment thereof has a V78F mutation in the heavy chain variable domain. In some embodiments, the heavy chain variable domain may have HC-CDR1, HC-CDR2, and HC-CDR3 with the amino acid sequence of SEQ ID NOs: 316, 318, and 320, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 314. In some embodiments, the light chain variable domain may have LC-CDR1, LC-CDR2, and LC-CDR3 with the amino acid sequence of SEQ ID NOs: 308, 310, and 312, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 306. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 315, 317, 319, 307, 309, 311, 313, and 305, respectively;

(u) a PGT121 variant antibody or fragment thereof featured herein includes (i) the following six complementarity determining regions (CDRs): a heavy chain (HC)-CDR1 with the amino acid sequence of SEQ ID NO: 332, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 332; a HC-CDR2 with the amino acid sequence of SEQ ID NO: 334, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 334; a HC-CDR3 with the amino acid sequence of SEQ ID NO: 336, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 336; a light chain (LC)-CDR1 with the amino acid sequence of SEQ ID NO: 324, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 324; a LC-CDR2 with the amino acid sequence of SEQ ID NO: 326, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 326; and a LC-CDR3 with the amino acid sequence of SEQ ID NO: 328, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 328; and/or (ii) a heavy chain variable domain having amino acids 20-481 of SEQ ID NO: 330, and a light chain variable domain having amino acids 20-230 of SEQ ID NO: 322; the antibody or antigen-binding fragment thereof has a S81K mutation in the heavy chain variable domain. In some embodiments, the heavy chain variable domain may have HC-CDR1, HC-CDR2, and HC-CDR3 with the amino acid sequence of SEQ ID NOs: 332, 334, and 336, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 330. In some embodiments, the light chain variable domain may have LC-CDR1, LC-CDR2, and LC-CDR3 with the amino acid sequence of SEQ ID NOs: 324, 326, and 328, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 322. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 331, 333, 335, 323, 325, 327, 329, and 321, respectively;

(v) a PGT121 variant antibody or fragment thereof featured herein includes (i) the following six complementarity determining regions (CDRs): a heavy chain (HC)-CDR1 with the amino acid sequence of SEQ ID NO: 348, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 348; a HC-CDR2 with the amino acid sequence of SEQ ID NO: 350, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 350; a HC-CDR3 with the amino acid sequence of SEQ ID NO: 352, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 352; a light chain (LC)-CDR1 with the amino acid sequence of SEQ ID NO: 340, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 340; a LC-CDR2 with the amino acid sequence of SEQ ID NO: 342, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 342; and a LC-CDR3 with the amino acid sequence of SEQ ID NO: 344, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 344; and/or (ii) a heavy chain variable domain having amino acids 20-481 of SEQ ID NO: 346, and a light chain variable domain having amino acids 20-230 of SEQ ID NO: 338; the antibody or antigen-binding fragment thereof has a V83S mutation in the heavy chain variable domain. In some embodiments, the heavy chain variable domain may have HC-CDR1, HC-CDR2, and HC-CDR3 with the amino acid sequence of SEQ ID NOs: 348, 350, and 352, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 346. In some embodiments, the light chain variable domain may have LC-CDR1, LC-CDR2, and LC-CDR3 with the amino acid sequence of SEQ ID NOs: 340, 342, and 344, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 338. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 347, 349, 351, 339, 341, 343, 345, and 337, respectively;

(w) a PGT121 variant antibody or fragment thereof featured herein includes (i) the following six complementarity determining regions (CDRs): a heavy chain (HC)-CDR1 with the amino acid sequence of SEQ ID NO: 364, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 364; a HC-CDR2 with the amino acid sequence of SEQ ID NO: 366, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 366; a HC-CDR3 with the amino acid sequence of SEQ ID NO: 368, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 368; a light chain (LC)-CDR1 with the amino acid sequence of SEQ ID NO: 356, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 356; a LC-CDR2 with the amino acid sequence of SEQ ID NO: 358, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 358; and a LC-CDR3 with the amino acid sequence of SEQ ID NO: 360, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 360; and/or (ii) a heavy chain variable domain having amino acids 20-481 of SEQ ID NO: 362, and a light chain variable domain having amino acids 20-230 of SEQ ID NO: 354; the antibody or antigen-binding fragment thereof has a A84S mutation in the heavy chain variable domain. In some embodiments, the heavy chain variable domain may have HC-CDR1, HC-CDR2, and HC-CDR3 with the amino acid sequence of SEQ ID NOs: 364, 366, and 368, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 362. In some embodiments, the light chain variable domain may have LC-CDR1, LC-CDR2, and LC-CDR3 with the amino acid sequence of SEQ ID NOs: 356, 358, and 360, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 354. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 363, 365, 367, 355, 357, 359, 361, and 353, respectively;

(x) a PGT121 variant antibody or fragment thereof featured herein includes (i) the following six complementarity determining regions (CDRs): a heavy chain (HC)-CDR1 with the amino acid sequence of SEQ ID NO: 380, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 380; a HC-CDR2 with the amino acid sequence of SEQ ID NO: 382, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 382; a HC-CDR3 with the amino acid sequence of SEQ ID NO: 384, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 384; a light chain (LC)-CDR1 with the amino acid sequence of SEQ ID NO: 372, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 372; a LC-CDR2 with the amino acid sequence of SEQ ID NO: 374, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 374; and a LC-CDR3 with the amino acid sequence of SEQ ID NO: 376, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 376; and/or (ii) a heavy chain variable domain having amino acids 20-481 of SEQ ID NO: 378, and a light chain variable domain having amino acids 20-230 of SEQ ID NO: 370; the antibody or antigen-binding fragment thereof has a K92V mutation in the heavy chain variable domain. In some embodiments, the heavy chain variable domain may have HC-CDR1, HC-CDR2, and HC-CDR3 with the amino acid sequence of SEQ ID NOs: 380, 382, and 384, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 378. In some embodiments, the light chain variable domain may have LC-CDR1, LC-CDR2, and LC-CDR3 with the amino acid sequence of SEQ ID NOs: 372, 374, and 376, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 370. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 379, 381, 383, 371, 373, 375, 377, and 369, respectively;

(y) a PGT121 variant antibody or fragment thereof featured herein includes (i) the following six complementarity determining regions (CDRs): a heavy chain (HC)-CDR1 with the amino acid sequence of SEQ ID NO: 396, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 396; a HC-CDR2 with the amino acid sequence of SEQ ID NO: 398, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 398; a HC-CDR3 with the amino acid sequence of SEQ ID NO: 400, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 400; a light chain (LC)-CDR1 with the amino acid sequence of SEQ ID NO: 388, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 388; a LC-CDR2 with the amino acid sequence of SEQ ID NO: 390, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 390; and a LC-CDR3 with the amino acid sequence of SEQ ID NO: 392, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 392; and/or (ii) a heavy chain variable domain having amino acids 20-481 of SEQ ID NO: 394, and a light chain variable domain having amino acids 20-230 of SEQ ID NO: 386; the antibody or antigen-binding fragment thereof has a N124Q mutation in the heavy chain variable domain. In some embodiments, the heavy chain variable domain may have HC-CDR1, HC-CDR2, and HC-CDR3 with the amino acid sequence of SEQ ID NOs: 396, 398, and 400, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 394. In some embodiments, the light chain variable domain may have LC-CDR1, LC-CDR2, and LC-CDR3 with the amino acid sequence of SEQ ID NOs: 388, 390, and 392, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 386. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 395, 397, 399, 387, 389, 391, 393, and 385, respectively;

(z) a PGT121 variant antibody or fragment thereof featured herein includes (i) the following six complementarity determining regions (CDRs): a heavy chain (HC)-CDR1 with the amino acid sequence of SEQ ID NO: 412, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 412; a HC-CDR2 with the amino acid sequence of SEQ ID NO: 414, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 414; a HC-CDR3 with the amino acid sequence of SEQ ID NO: 416, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 416; a light chain (LC)-CDR1 with the amino acid sequence of SEQ ID NO: 404, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 404; a LC-CDR2 with the amino acid sequence of SEQ ID NO: 406, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 406; and a LC-CDR3 with the amino acid sequence of SEQ ID NO: 408, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 408; and/or (ii) a heavy chain variable domain having amino acids 20-481 of SEQ ID NO: 410, and alight chain variable domain having amino acids 20-230 of SEQ ID NO: 402. In some embodiments, the heavy chain variable domain may have HC-CDR1, HC-CDR2, and HC-CDR3 with the amino acid sequence of SEQ ID NOs: 412, 414, and 416, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 410. In some embodiments, the light chain variable domain may have LC-CDR1, LC-CDR2, and LC-CDR3 with the amino acid sequence of SEQ ID NOs: 404, 406, and 408, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 402. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 411, 413, 415, 403, 405, 407, 409, and 401, respectively;

(aa) a PGT121 variant antibody or fragment thereof featured herein includes (i) the following six complementarity determining regions (CDRs): a heavy chain (HC)-CDR1 with the amino acid sequence of SEQ ID NO: 428, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 428; a HC-CDR2 with the amino acid sequence of SEQ ID NO: 430, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 430; a HC-CDR3 with the amino acid sequence of SEQ ID NO: 432, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 432; a light chain (LC)-CDR1 with the amino acid sequence of SEQ ID NO: 420, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 420; a LC-CDR2 with the amino acid sequence of SEQ ID NO: 422, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 422; and a LC-CDR3 with the amino acid sequence of SEQ ID NO: 424, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 424; and/or (ii) a heavy chain variable domain having amino acids 20-481 of SEQ ID NO: 426, and a light chain variable domain having amino acids 20-230 of SEQ ID NO: 418. In some embodiments, the heavy chain variable domain may have HC-CDR1, HC-CDR2, and HC-CDR3 with the amino acid sequence of SEQ ID NOs: 428, 430, and 432, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 426. In some embodiments, the light chain variable domain may have LC-CDR1, LC-CDR2, and LC-CDR3 with the amino acid sequence of SEQ ID NOs: 420, 422, and 424, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 418. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 427, 429, 431, 419, 421, 423, 425, and 417, respectively;

(bb) a PGT121 variant antibody or fragment thereof featured herein includes (i) the following six complementarity determining regions (CDRs): a heavy chain (HC)-CDR1 with the amino acid sequence of SEQ ID NO: 444, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 444; a HC-CDR2 with the amino acid sequence of SEQ ID NO: 446, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 446; a HC-CDR3 with the amino acid sequence of SEQ ID NO: 448, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 448; a light chain (LC)-CDR1 with the amino acid sequence of SEQ ID NO: 436, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 436; a LC-CDR2 with the amino acid sequence of SEQ ID NO: 438, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 438; and a LC-CDR3 with the amino acid sequence of SEQ ID NO: 440, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 440; and/or (ii) a heavy chain variable domain having amino acids 20-481 of SEQ ID NO: 442, and a light chain variable domain having amino acids 20-230 of SEQ ID NO: 434. In some embodiments, the heavy chain variable domain may have HC-CDR1, HC-CDR2, and HC-CDR3 with the amino acid sequence of SEQ ID NOs: 444, 446, and 448, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 442. In some embodiments, the light chain variable domain may have LC-CDR1, LC-CDR2, and LC-CDR3 with the amino acid sequence of SEQ ID NOs: 436, 438, and 440, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 434. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 443, 445, 447, 435, 437, 439, 441, and 433, respectively;

(cc) a PGT121 variant antibody or fragment thereof featured herein includes (i) the following six complementarity determining regions (CDRs): a heavy chain (HC)-CDR1 with the amino acid sequence of SEQ ID NO: 460, a or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 460; HC-CDR2 with the amino acid sequence of SEQ ID NO: 462, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 462; a HC-CDR3 with the amino acid sequence of SEQ ID NO: 464, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 464; a light chain (LC)-CDR1 with the amino acid sequence of SEQ ID NO: 452, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 452; a LC-CDR2 with the amino acid sequence of SEQ ID NO: 454, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 454; and a LC-CDR3 with the amino acid sequence of SEQ ID NO: 456, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 456; and/or (ii) a heavy chain variable domain having amino acids 20-481 of SEQ ID NO: 458, and a light chain variable domain having amino acids 20-230 of SEQ ID NO: 450. In some embodiments, the heavy chain variable domain may have HC-CDR1, HC-CDR2, and HC-CDR3 with the amino acid sequence of SEQ ID NOs: 460, 462, and 464, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 458. In some embodiments, the light chain variable domain may have LC-CDR1, LC-CDR2, and LC-CDR3 with the amino acid sequence of SEQ ID NOs: 452, 454, and 456, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 450. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 459, 461, 463, 451, 453, 455, 457, and 449, respectively;

(dd) a PGT121 variant antibody or fragment thereof featured herein includes (i) the following six complementarity determining regions (CDRs): a heavy chain (HC)-CDR1 with the amino acid sequence of SEQ ID NO: 476, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 476; a HC-CDR2 with the amino acid sequence of SEQ ID NO: 478, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 478; a HC-CDR3 with the amino acid sequence of SEQ ID NO: 480, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 480; a light chain (LC)-CDR1 with the amino acid sequence of SEQ ID NO: 468, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 468; a LC-CDR2 with the amino acid sequence of SEQ ID NO: 470, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 470; and a LC-CDR3 with the amino acid sequence of SEQ ID NO: 472, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 472; and/or (ii) a heavy chain variable domain having amino acids 20-481 of SEQ ID NO: 474, and a light chain variable domain having amino acids 20-230 of SEQ ID NO: 466; the antibody or antigen-binding fragment thereof has a R39Q mutation in the heavy chain variable domain, and a H30Q mutation in the light chain variable domain. In some embodiments, the heavy chain variable domain may have HC-CDR1, HC-CDR2, and HC-CDR3 with the amino acid sequence of SEQ ID NOs: 476, 478, and 480, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 474. In some embodiments, the light chain variable domain may have LC-CDR1, LC-CDR2, and LC-CDR3 with the amino acid sequence of SEQ ID NOs: 468, 470, and 472, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 466. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 475, 477, 479, 467, 469, 471, 473, and 465, respectively;

(ee) a PGT121 variant antibody or fragment thereof featured herein includes (i) the following six complementarity determining regions (CDRs): a heavy chain (HC)-CDR1 with the amino acid sequence of SEQ ID NO: 492, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 492; a HC-CDR2 with the amino acid sequence of SEQ ID NO: 494, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 494; a HC-CDR3 with the amino acid sequence of SEQ ID NO: 496, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 496; a light chain (LC)-CDR1 with the amino acid sequence of SEQ ID NO: 484, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 484; a LC-CDR2 with the amino acid sequence of SEQ ID NO: 486, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 486; and a LC-CDR3 with the amino acid sequence of SEQ ID NO: 488, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 488; and/or (ii) a heavy chain variable domain having amino acids 20-481 of SEQ ID NO: 490, and a light chain variable domain having amino acids 20-230 of SEQ ID NO: 482; the antibody or antigen-binding fragment thereof has R39Q, S40P, and K92V mutations in the heavy chain variable domain. In some embodiments, the heavy chain variable domain may have HC-CDR1, HC-CDR2, and HC-CDR3 with the amino acid sequence of SEQ ID NOs: 492, 494, and 496, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 490. In some embodiments, the light chain variable domain may have LC-CDR1, LC-CDR2, and LC-CDR3 with the amino acid sequence of SEQ ID NOs: 484, 486, and 488, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 482. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 491, 493, 495, 483, 485, 487, 489, and 481, respectively;

(ff) a PGT121 variant antibody or fragment thereof featured herein includes (i) the following six complementarity determining regions (CDRs): a heavy chain (HC)-CDR1 with the amino acid sequence of SEQ ID NO: 508, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 508; a HC-CDR2 with the amino acid sequence of SEQ ID NO: 510, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 510; a HC-CDR3 with the amino acid sequence of SEQ ID NO: 512, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 512; a light chain (LC)-CDR1 with the amino acid sequence of SEQ ID NO: 500, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 500; a LC-CDR2 with the amino acid sequence of SEQ ID NO: 502, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 502; and a LC-CDR3 with the amino acid sequence of SEQ ID NO: 504, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 504; and/or (ii) a heavy chain variable domain having amino acids 20-481 of SEQ ID NO: 506, and a light chain variable domain having amino acids 20-230 of SEQ ID NO: 498. In some embodiments, the heavy chain variable domain may have HC-CDR1, HC-CDR2, and HC-CDR3 with the amino acid sequence of SEQ ID NOs: 508, 510, and 512, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 506. In some embodiments, the light chain variable domain may have LC-CDR1, LC-CDR2, and LC-CDR3 with the amino acid sequence of SEQ ID NOs: 500, 502, and 504, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 498. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 507, 509, 511, 499, 501, 503, 505, and 497, respectively;

(gg) a PGT121 variant antibody or fragment thereof featured herein includes (i) the following six complementarity determining regions (CDRs): a heavy chain (HC)-CDR1 with the amino acid sequence of SEQ ID NO: 524, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 524; a HC-CDR2 with the amino acid sequence of SEQ ID NO: 526, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 526; a HC-CDR3 with the amino acid sequence of SEQ ID NO: 528, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 528; a light chain (LC)-CDR1 with the amino acid sequence of SEQ ID NO: 516, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 516; a LC-CDR2 with the amino acid sequence of SEQ ID NO: 518, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 518; and a LC-CDR3 with the amino acid sequence of SEQ ID NO: 520, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 520; and/or (ii) a heavy chain variable domain having amino acids 20-481 of SEQ ID NO: 522, and a light chain variable domain having amino acids 20-230 of SEQ ID NO: 514. In some embodiments, the heavy chain variable domain may have HC-CDR1, HC-CDR2, and HC-CDR3 with the amino acid sequence of SEQ ID NOs: 524, 526, and 528, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 522. In some embodiments, the light chain variable domain may have LC-CDR1, LC-CDR2, and LC-CDR3 with the amino acid sequence of SEQ ID NOs: 516, 518, and 520, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 514. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 523, 525, 527, 515, 517, 519, 521, and 513, respectively;

(hh) a PGT121 variant antibody or fragment thereof featured herein includes (i) the following six complementarity determining regions (CDRs): a heavy chain (HC)-CDR1 with the amino acid sequence of SEQ ID NO: 540, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 540; a HC-CDR2 with the amino acid sequence of SEQ ID NO: 542, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 542; a HC-CDR3 with the amino acid sequence of SEQ ID NO: 544, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 544; a light chain (LC)-CDR1 with the amino acid sequence of SEQ ID NO: 532, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 532; a LC-CDR2 with the amino acid sequence of SEQ ID NO: 534, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 534; and a LC-CDR3 with the amino acid sequence of SEQ ID NO: 536, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 536; and/or (ii) a heavy chain variable domain having amino acids 20-481 of SEQ ID NO: 538, and a light chain variable domain having amino acids 20-230 of SEQ ID NO: 530; the antibody or antigen-binding fragment thereof has a K92V mutations in the heavy chain variable domain, and E9Q and H30Q mutations in the light chain variable domain. In some embodiments, the heavy chain variable domain may have HC-CDR1, HC-CDR2, and HC-CDR3 with the amino acid sequence of SEQ ID NOs: 540, 542, and 544, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 538. In some embodiments, the light chain variable domain may have LC-CDR1, LC-CDR2, and LC-CDR3 with the amino acid sequence of SEQ ID NOs: 532, 534, and 536, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 530. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 539, 541, 543, 531, 533, 535, 537, and 529, respectively;

(ii) a PGT121 variant antibody or fragment thereof featured herein includes (i) the following six complementarity determining regions (CDRs): a heavy chain (HC)-CDR1 with the amino acid sequence of SEQ ID NO: 556, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 556; a HC-CDR2 with the amino acid sequence of SEQ ID NO: 558, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 558; a HC-CDR3 with the amino acid sequence of SEQ ID NO: 560, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 560; a light chain (LC)-CDR1 with the amino acid sequence of SEQ ID NO: 548, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 548; a LC-CDR2 with the amino acid sequence of SEQ ID NO: 550, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 550; and a LC-CDR3 with the amino acid sequence of SEQ ID NO: 552, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 552; and/or (ii) a heavy chain variable domain having amino acids 20-481 of SEQ ID NO: 554, and a light chain variable domain having amino acids 20-230 of SEQ ID NO: 546. In some embodiments, the heavy chain variable domain may have HC-CDR1, HC-CDR2, and HC-CDR3 with the amino acid sequence of SEQ ID NOs: 556, 558, and 560, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 554. In some embodiments, the light chain variable domain may have LC-CDR1, LC-CDR2, and LC-CDR3 with the amino acid sequence of SEQ ID NOs: 548, 550, and 552, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 546. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 555, 557, 559, 547, 549, 551, 553, and 545, respectively;

(jj) a PGT121 variant antibody or fragment thereof featured herein includes (i) the following six complementarity determining regions (CDRs): a heavy chain (HC)-CDR1 with the amino acid sequence of SEQ ID NO: 572, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 572; a HC-CDR2 with the amino acid sequence of SEQ ID NO: 574, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 574; a HC-CDR3 with the amino acid sequence of SEQ ID NO: 576, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 576; a light chain (LC)-CDR1 with the amino acid sequence of SEQ ID NO: 564, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 564; a LC-CDR2 with the amino acid sequence of SEQ ID NO: 566, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 566; and a LC-CDR3 with the amino acid sequence of SEQ ID NO: 568, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 568; and/or (ii) a heavy chain variable domain having amino acids 20-481 of SEQ ID NO: 570, and a light chain variable domain having amino acids 20-230 of SEQ ID NO: 562. In some embodiments, the heavy chain variable domain may have HC-CDR1, HC-CDR2, and HC-CDR3 with the amino acid sequence of SEQ ID NOs: 572, 574, and 576, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 570. In some embodiments, the light chain variable domain may have LC-CDR1, LC-CDR2, and LC-CDR3 with the amino acid sequence of SEQ ID NOs: 564, 566, and 568, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 562. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 571, 573, 575, 563, 565, 567, 569, and 561, respectively;

(kk) a PGT121 variant antibody or fragment thereof featured herein includes (i) the following six complementarity determining regions (CDRs): a heavy chain (HC)-CDR1 with the amino acid sequence of SEQ ID NO: 588, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 588; a HC-CDR2 with the amino acid sequence of SEQ ID NO: 590, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 590; a HC-CDR3 with the amino acid sequence of SEQ ID NO: 592, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 592; a light chain (LC)-CDR1 with the amino acid sequence of SEQ ID NO: 580, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 580; a LC-CDR2 with the amino acid sequence of SEQ ID NO: 582, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 582; and a LC-CDR3 with the amino acid sequence of SEQ ID NO: 584, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 584; and/or (ii) a heavy chain variable domain having amino acids 20-481 of SEQ ID NO: 586, and a light chain variable domain having amino acids 20-230 of SEQ ID NO: 578. In some embodiments, the heavy chain variable domain may have HC-CDR1, HC-CDR2, and HC-CDR3 with the amino acid sequence of SEQ ID NOs: 588, 590, and 592, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 586. In some embodiments, the light chain variable domain may have LC-CDR1, LC-CDR2, and LC-CDR3 with the amino acid sequence of SEQ ID NOs: 580, 582, and 584, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 578. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 587, 589, 591, 579, 581, 583, 585, and 577, respectively;

(ll) a PGT121 variant antibody or fragment thereof featured herein includes (i) the following six complementarity determining regions (CDRs): a heavy chain (HC)-CDR1 with the amino acid sequence of SEQ ID NO: 604, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 604; a HC-CDR2 with the amino acid sequence of SEQ ID NO: 606, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 606; and a HC-CDR3 with the amino acid sequence of SEQ ID NO: 608, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 608; a light chain (LC)-CDR1 with the amino acid sequence of SEQ ID NO: 596, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 596; a LC-CDR2 with the amino acid sequence of SEQ ID NO: 598, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 598; and a LC-CDR3 with the amino acid sequence of SEQ ID NO: 600, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 600; and/or (ii) a heavy chain variable domain having amino acids 20-481 of SEQ ID NO: 602, and a light chain variable domain having amino acids 20-230 of SEQ ID NO: 594. In some embodiments, the heavy chain variable domain may have HC-CDR1, HC-CDR2, and HC-CDR3 with the amino acid sequence of SEQ ID NOs: 604, 606, and 608, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 602. In some embodiments, the light chain variable domain may have LC-CDR1, LC-CDR2, and LC-CDR3 with the amino acid sequence of SEQ ID NOs: 596, 598, and 600, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 594. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 603, 605, 607, 595, 597, 599, 601, and 593, respectively;

(mm) a PGT121 variant antibody or fragment thereof featured herein includes (i) the following six complementarity determining regions (CDRs): a heavy chain (HC)-CDR1 with the amino acid sequence of SEQ ID NO: 620, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 620; a HC-CDR2 with the amino acid sequence of SEQ ID NO: 622, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 622; a HC-CDR3 with the amino acid sequence of SEQ ID NO: 624, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 624; a light chain (LC)-CDR1 with the amino acid sequence of SEQ ID NO: 612, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 612; a LC-CDR2 with the amino acid sequence of SEQ ID NO: 614, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 614; and a LC-CDR3 with the amino acid sequence of SEQ ID NO: 616, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 616; and/or (ii) a heavy chain variable domain having amino acids 20-481 of SEQ ID NO: 618, and a light chain variable domain having amino acids 20-230 of SEQ ID NO: 610. In some embodiments, the heavy chain variable domain may have HC-CDR1, HC-CDR2, and HC-CDR3 with the amino acid sequence of SEQ ID NOs: 620, 622, and 624, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 618. In some embodiments, the light chain variable domain may have LC-CDR1, LC-CDR2, and LC-CDR3 with the amino acid sequence of SEQ ID NOs: 612, 614, and 616, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 610. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 619, 621, 623, 611, 613, 615, 617, and 609, respectively;

(nn) a PGT121 variant antibody or fragment thereof featured herein includes (i) the following six complementarity determining regions (CDRs): a heavy chain (HC)-CDR1 with the amino acid sequence of SEQ ID NO: 636, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 636; a HC-CDR2 with the amino acid sequence of SEQ ID NO: 638, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 638; a HC-CDR3 with the amino acid sequence of SEQ ID NO: 640, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 640; a light chain (LC)-CDR1 with the amino acid sequence of SEQ ID NO: 628, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 628; a LC-CDR2 with the amino acid sequence of SEQ ID NO: 630, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 630; and a LC-CDR3 with the amino acid sequence of SEQ ID NO: 632, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 632; and/or (ii) a heavy chain variable domain having amino acids 20-481 of SEQ ID NO: 634, and a light chain variable domain having amino acids 20-230 of SEQ ID NO: 626. In some embodiments, the heavy chain variable domain may have HC-CDR1, HC-CDR2, and HC-CDR3 with the amino acid sequence of SEQ ID NOs: 636, 638, and 640, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 634. In some embodiments, the light chain variable domain may have LC-CDR1, LC-CDR2, and LC-CDR3 with the amino acid sequence of SEQ ID NOs: 628, 630, and 632, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 626. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 635, 637, 639, 627, 629, 631, 633, and 625, respectively;

(oo) a PGT121 variant antibody or fragment thereof featured herein includes (i) the following six complementarity determining regions (CDRs): a heavy chain (HC)-CDR1 with the amino acid sequence of SEQ ID NO: 652, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 652; a HC-CDR2 with the amino acid sequence of SEQ ID NO: 654, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 654; a HC-CDR3 with the amino acid sequence of SEQ ID NO: 656, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 656; a light chain (LC)-CDR1 with the amino acid sequence of SEQ ID NO: 644, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 644; a LC-CDR2 with the amino acid sequence of SEQ ID NO: 646, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 646; and a LC-CDR3 with the amino acid sequence of SEQ ID NO: 648, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 648; and/or (ii) a heavy chain variable domain having amino acids 20-481 of SEQ ID NO: 650, and a light chain variable domain having amino acids 20-230 of SEQ ID NO: 642. In some embodiments, the heavy chain variable domain may have HC-CDR1, HC-CDR2, and HC-CDR3 with the amino acid sequence of SEQ ID NOs: 652, 654, and 656, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 650. In some embodiments, the light chain variable domain may have LC-CDR1, LC-CDR2, and LC-CDR3 with the amino acid sequence of SEQ ID NOs: 644, 646, and 648, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 642. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 651, 653, 655, 643, 645, 647, 649, and 641, respectively;

(pp) a PGT121 variant antibody or fragment thereof featured herein includes (i) the following six complementarity determining regions (CDRs): a heavy chain (HC)-CDR1 with the amino acid sequence of SEQ ID NO: 668, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 668; a HC-CDR2 with the amino acid sequence of SEQ ID NO: 670, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 670; a HC-CDR3 with the amino acid sequence of SEQ ID NO: 672, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 672; a light chain (LC)-CDR1 with the amino acid sequence of SEQ ID NO: 660, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 660; a LC-CDR2 with the amino acid sequence of SEQ ID NO: 662, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 662; and a LC-CDR3 with the amino acid sequence of SEQ ID NO: 664, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 664; and/or (ii) a heavy chain variable domain having amino acids 20-481 of SEQ ID NO: 666, and a light chain variable domain having amino acids 20-230 of SEQ ID NO: 658. In some embodiments, the heavy chain variable domain may have HC-CDR1, HC-CDR2, and HC-CDR3 with the amino acid sequence of SEQ ID NOs: 668, 670, and 672, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 666. In some embodiments, the light chain variable domain may have LC-CDR1, LC-CDR2, and LC-CDR3 with the amino acid sequence of SEQ ID NOs: 660, 662, and 664, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 657. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 667, 669, 671, 659, 661, 663, 665, and 657, respectively;

(qq) a PGT121 variant antibody or fragment thereof featured herein includes (i) the following six complementarity determining regions (CDRs): a heavy chain (HC)-CDR1 with the amino acid sequence of SEQ ID NO: 684, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 684; a HC-CDR2 with the amino acid sequence of SEQ ID NO: 686, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 686; a HC-CDR3 with the amino acid sequence of SEQ ID NO: 688, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 688; a light chain (LC)-CDR1 with the amino acid sequence of SEQ ID NO: 676, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 676; a LC-CDR2 with the amino acid sequence of SEQ ID NO: 678, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 678; and a LC-CDR3 with the amino acid sequence of SEQ ID NO: 680, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 680; and/or (ii) a heavy chain variable domain having amino acids 20-481 of SEQ ID NO: 682, and a light chain variable domain having amino acids 20-230 of SEQ ID NO: 674. In some embodiments, the heavy chain variable domain may have HC-CDR1, HC-CDR2, and HC-CDR3 with the amino acid sequence of SEQ ID NOs: 684, 686, and 688, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 682. In some embodiments, the light chain variable domain may have LC-CDR1, LC-CDR2, and LC-CDR3 with the amino acid sequence of SEQ ID NOs: 676, 678, and 680, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 674. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 683, 685, 687, 675, 677, 679, 681, and 673, respectively;

(rr) a PGT121 variant antibody or fragment thereof featured herein includes (i) the following six complementarity determining regions (CDRs): a heavy chain (HC)-CDR1 with the amino acid sequence of SEQ ID NO: 700, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 700; a HC-CDR2 with the amino acid sequence of SEQ ID NO: 702, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 702; a HC-CDR3 with the amino acid sequence of SEQ ID NO: 704, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 704; a light chain (LC)-CDR1 with the amino acid sequence of SEQ ID NO: 692, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 692; a LC-CDR2 with the amino acid sequence of SEQ ID NO: 694, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 694; and a LC-CDR3 with the amino acid sequence of SEQ ID NO: 696, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 696; and/or (ii) a heavy chain variable domain having amino acids 20-481 of SEQ ID NO: 698, and a light chain variable domain having amino acids 20-230 of SEQ ID NO: 690. In some embodiments, the heavy chain variable domain may have HC-CDR1, HC-CDR2, and HC-CDR3 with the amino acid sequence of SEQ ID NOs: 700, 702, and 704, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 698. In some embodiments, the light chain variable domain may have LC-CDR1, LC-CDR2, and LC-CDR3 with the amino acid sequence of SEQ ID NOs: 692, 694, and 696, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 690. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 699, 701, 703, 691, 693, 695, 697, and 689, respectively;

(ss) a PGT121 variant antibody or fragment thereof featured herein includes (i) the following six complementarity determining regions (CDRs): a heavy chain (HC)-CDR1 with the amino acid sequence of SEQ ID NO: 716, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 716; a HC-CDR2 with the amino acid sequence of SEQ ID NO: 718, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 718; a HC-CDR3 with the amino acid sequence of SEQ ID NO: 720, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 720; a light chain (LC)-CDR1 with the amino acid sequence of SEQ ID NO: 708, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 708; a LC-CDR2 with the amino acid sequence of SEQ ID NO: 710, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 710; and a LC-CDR3 with the amino acid sequence of SEQ ID NO: 712, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 712; and/or (ii) a heavy chain variable domain having amino acids 20-481 of SEQ ID NO: 714, and a light chain variable domain having amino acids 20-230 of SEQ ID NO: 706. In some embodiments, the heavy chain variable domain may have HC-CDR1, HC-CDR2, and HC-CDR3 with the amino acid sequence of SEQ ID NOs: 716, 718, and 720, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 714. In some embodiments, the light chain variable domain may have LC-CDR1, LC-CDR2, and LC-CDR3 with the amino acid sequence of SEQ ID NOs: 708, 710, and 712, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 706. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 715, 717, 719, 707, 709, 711, 713, and 705, respectively;

(tt) a PGT121 variant antibody or fragment thereof featured herein includes (i) the following six complementarity determining regions (CDRs): a heavy chain (HC)-CDR1 with the amino acid sequence of SEQ ID NO: 732, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 732; a HC-CDR2 with the amino acid sequence of SEQ ID NO: 734, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 734; a HC-CDR3 with the amino acid sequence of SEQ ID NO: 736, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 736; a light chain (LC)-CDR1 with the amino acid sequence of SEQ ID NO: 724, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 724; a LC-CDR2 with the amino acid sequence of SEQ ID NO: 726, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 726; and a LC-CDR3 with the amino acid sequence of SEQ ID NO: 728, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 728; and/or (ii) a heavy chain variable domain having amino acids 20-481 of SEQ ID NO: 730, and a light chain variable domain having amino acids 20-230 of SEQ ID NO: 722. In some embodiments, the heavy chain variable domain may have HC-CDR1, HC-CDR2, and HC-CDR3 with the amino acid sequence of SEQ ID NOs: 732, 734, and 736, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 730. In some embodiments, the light chain variable domain may have LC-CDR1, LC-CDR2, and LC-CDR3 with the amino acid sequence of SEQ ID NOs: 724, 726, and 728, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 722. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 731, 733, 735, 723, 725, 727, 729, and 721, respectively;

(uu) a PGT121 variant antibody or fragment thereof featured herein includes (i) the following six complementarity determining regions (CDRs): a heavy chain (HC)-CDR1 with the amino acid sequence of SEQ ID NO: 748, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 748; a HC-CDR2 with the amino acid sequence of SEQ ID NO: 750, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 750; a HC-CDR3 with the amino acid sequence of SEQ ID NO: 752, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 752; a light chain (LC)-CDR1 with the amino acid sequence of SEQ ID NO: 740, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 740; a LC-CDR2 with the amino acid sequence of SEQ ID NO: 742, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 742; and a LC-CDR3 with the amino acid sequence of SEQ ID NO: 744, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 744; and/or (ii) a heavy chain variable domain having amino acids 20-481 of SEQ ID NO: 746, and a light chain variable domain having amino acids 20-230 of SEQ ID NO: 738. In some embodiments, the heavy chain variable domain may have HC-CDR1, HC-CDR2, and HC-CDR3 with the amino acid sequence of SEQ ID NOs: 748, 750, and 752, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 746. In some embodiments, the light chain variable domain may have LC-CDR1, LC-CDR2, and LC-CDR3 with the amino acid sequence of SEQ ID NOs: 740, 742, and 744, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 738. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 747, 749, 751, 739, 741, 743, 745, and 737, respectively;

(vv) a PGT121 variant antibody or fragment thereof featured herein includes (i) the following six complementarity determining regions (CDRs): a heavy chain (HC)-CDR1 with the amino acid sequence of SEQ ID NO: 764, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 764; a HC-CDR2 with the amino acid sequence of SEQ ID NO: 766, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 766; a HC-CDR3 with the amino acid sequence of SEQ ID NO: 768, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 768; a light chain (LC)-CDR1 with the amino acid sequence of SEQ ID NO: 756, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 756; a LC-CDR2 with the amino acid sequence of SEQ ID NO: 758, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 758; and a LC-CDR3 with the amino acid sequence of SEQ ID NO: 760, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 760; and/or (ii) a heavy chain variable domain having amino acids 20-481 of SEQ ID NO: 762, and a light chain variable domain having amino acids 20-230 of SEQ ID NO: 754. In some embodiments, the heavy chain variable domain may have HC-CDR1, HC-CDR2, and HC-CDR3 with the amino acid sequence of SEQ ID NOs: 764, 766, and 768, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 762. In some embodiments, the light chain variable domain may have LC-CDR1, LC-CDR2, and LC-CDR3 with the amino acid sequence of SEQ ID NOs: 756, 758, and 760, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 754. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 763, 765, 767, 755, 757, 759, 761, and 753, respectively;

(ww) a PGT121 variant antibody or fragment thereof featured herein includes (i) the following six complementarity determining regions (CDRs): a heavy chain (HC)-CDR1 with the amino acid sequence of SEQ ID NO: 780, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 780; a HC-CDR2 with the amino acid sequence of SEQ ID NO: 782, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 782; a HC-CDR3 with the amino acid sequence of SEQ ID NO: 784, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 784; a light chain (LC)-CDR1 with the amino acid sequence of SEQ ID NO: 772, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 772; a LC-CDR2 with the amino acid sequence of SEQ ID NO: 774, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 774; and a LC-CDR3 with the amino acid sequence of SEQ ID NO: 776, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 776; and/or (ii) a heavy chain variable domain having amino acids 20-481 of SEQ ID NO: 778, and a light chain variable domain having amino acids 20-230 of SEQ ID NO: 770. In some embodiments, the heavy chain variable domain may have HC-CDR1, HC-CDR2, and HC-CDR3 with the amino acid sequence of SEQ ID NOs: 780, 782, and 784, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 778. In some embodiments, the light chain variable domain may have LC-CDR1, LC-CDR2, and LC-CDR3 with the amino acid sequence of SEQ ID NOs: 772, 774, and 776, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 770. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 779, 781, 783, 771, 773, 775, 777, and 769, respectively;

(xx) a PGT121 variant antibody or fragment thereof featured herein includes (i) the following six complementarity determining regions (CDRs): a heavy chain (HC)-CDR1 with the amino acid sequence of SEQ ID NO: 796, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 796; a HC-CDR2 with the amino acid sequence of SEQ ID NO: 798, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 798; a HC-CDR3 with the amino acid sequence of SEQ ID NO: 800, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 800; a light chain (LC)-CDR1 with the amino acid sequence of SEQ ID NO: 788, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 788; a LC-CDR2 with the amino acid sequence of SEQ ID NO: 790, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 790; and a LC-CDR3 with the amino acid sequence of SEQ ID NO: 792, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 792; and/or (ii) a heavy chain variable domain having amino acids 20-481 of SEQ ID NO: 794, and a light chain variable domain having amino acids 20-230 of SEQ ID NO: 786. In some embodiments, the heavy chain variable domain may have HC-CDR1, HC-CDR2, and HC-CDR3 with the amino acid sequence of SEQ ID NOs: 796, 798, and 800, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 794. In some embodiments, the light chain variable domain may have LC-CDR1, LC-CDR2, and LC-CDR3 with the amino acid sequence of SEQ ID NOs: 788, 790, and 792, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 786. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 795, 797, 799, 787, 789, 791, 793, and 785, respectively;

(yy) a PGT121 variant antibody or fragment thereof featured herein includes (i) the following six complementarity determining regions (CDRs): a heavy chain (HC)-CDR1 with the amino acid sequence of SEQ ID NO: 812, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 812; a HC-CDR2 with the amino acid sequence of SEQ ID NO: 814, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 814; a HC-CDR3 with the amino acid sequence of SEQ ID NO: 816, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 816; a light chain (LC)-CDR1 with the amino acid sequence of SEQ ID NO: 804, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 804; a LC-CDR2 with the amino acid sequence of SEQ ID NO: 806, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 806; and a LC-CDR3 with the amino acid sequence of SEQ ID NO: 808, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 808; and/or (ii) a heavy chain variable domain having amino acids 20-481 of SEQ ID NO: 810, and a light chain variable domain having amino acids 20-230 of SEQ ID NO: 802. In some embodiments, the heavy chain variable domain may have HC-CDR1, HC-CDR2, and HC-CDR3 with the amino acid sequence of SEQ ID NOs: 812, 814, and 814, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 810. In some embodiments, the light chain variable domain may have LC-CDR1, LC-CDR2, and LC-CDR3 with the amino acid sequence of SEQ ID NOs: 804, 806, and 808, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 802. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 811, 813, 815, 803, 805, 807, 809, and 801, respectively;

(zz) a PGT121 variant antibody or fragment thereof featured herein includes (i) the following six complementarity determining regions (CDRs): a heavy chain (HC)-CDR1 with the amino acid sequence of SEQ ID NO: 828, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 828; a HC-CDR2 with the amino acid sequence of SEQ ID NO: 830, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 830; a HC-CDR3 with the amino acid sequence of SEQ ID NO: 832, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 832; a light chain (LC)-CDR1 with the amino acid sequence of SEQ ID NO: 820, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 820; a LC-CDR2 with the amino acid sequence of SEQ ID NO: 822, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 822; and a LC-CDR3 with the amino acid sequence of SEQ ID NO: 824, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 824; and/or (ii) a heavy chain variable domain having amino acids 20-481 of SEQ ID NO: 826, and a light chain variable domain having amino acids 20-230 of SEQ ID NO: 818. In some embodiments, the heavy chain variable domain may have HC-CDR1, HC-CDR2, and HC-CDR3 with the amino acid sequence of SEQ ID NOs: 828, 830, and 832, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 826. In some embodiments, the light chain variable domain may have LC-CDR1, LC-CDR2, and LC-CDR3 with the amino acid sequence of SEQ ID NOs: 820, 822, and 824, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 818. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 827, 829, 831, 819, 821, 823, 825, and 817, respectively;

(aaa) a PGT121 variant antibody or fragment thereof featured herein includes (i) the following six complementarity determining regions (CDRs): a heavy chain (HC)-CDR1 with the amino acid sequence of SEQ ID NO: 844, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 844; a HC-CDR2 with the amino acid sequence of SEQ ID NO: 846, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 846; a HC-CDR3 with the amino acid sequence of SEQ ID NO: 848, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 848; a light chain (LC)-CDR1 with the amino acid sequence of SEQ ID NO: 836, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 836; a LC-CDR2 with the amino acid sequence of SEQ ID NO: 838, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 838; and a LC-CDR3 with the amino acid sequence of SEQ ID NO: 840, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 840; and/or (ii) a heavy chain variable domain having amino acids 20-481 of SEQ ID NO: 842, and a light chain variable domain having amino acids 20-230 of SEQ ID NO: 834. In some embodiments, the heavy chain variable domain may have HC-CDR1, HC-CDR2, and HC-CDR3 with the amino acid sequence of SEQ ID NOs: 844, 846, and 848, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 842. In some embodiments, the light chain variable domain may have LC-CDR1, LC-CDR2, and LC-CDR3 with the amino acid sequence of SEQ ID NOs: 836, 838, and 840, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 834. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 843, 845, 847, 835, 837, 839, 841, and 833, respectively;

(bbb) a PGT121 variant antibody or fragment thereof featured herein includes (i) the following six complementarity determining regions (CDRs): a heavy chain (HC)-CDR1 with the amino acid sequence of SEQ ID NO: 860, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 860; a HC-CDR2 with the amino acid sequence of SEQ ID NO: 862, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 862; a HC-CDR3 with the amino acid sequence of SEQ ID NO: 864, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 864; a light chain (LC)-CDR1 with the amino acid sequence of SEQ ID NO: 852, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 852; a LC-CDR2 with the amino acid sequence of SEQ ID NO: 854, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 854; and a LC-CDR3 with the amino acid sequence of SEQ ID NO: 856, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 856; and/or (ii) a heavy chain variable domain having amino acids 20-481 of SEQ ID NO: 858, and a light chain variable domain having amino acids 20-230 of SEQ ID NO: 850. In some embodiments, the heavy chain variable domain may have HC-CDR1, HC-CDR2, and HC-CDR3 with the amino acid sequence of SEQ ID NOs: 860, 862, and 864, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 858. In some embodiments, the light chain variable domain may have LC-CDR1, LC-CDR2, and LC-CDR3 with the amino acid sequence of SEQ ID NOs: 852, 854, and 856, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 850. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 859, 861, 863, 851, 853, 855, 857, and 849, respectively;

(ccc) a PGT121 variant antibody or fragment thereof featured herein includes (i) the following six complementarity determining regions (CDRs): a heavy chain (HC)-CDR1 with the amino acid sequence of SEQ ID NO: 876, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 876; a HC-CDR2 with the amino acid sequence of SEQ ID NO: 878, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 878; a HC-CDR3 with the amino acid sequence of SEQ ID NO: 880, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 880; a light chain (LC)-CDR1 with the amino acid sequence of SEQ ID NO: 868, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 868; a LC-CDR2 with the amino acid sequence of SEQ ID NO: 870, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 870; and a LC-CDR3 with the amino acid sequence of SEQ ID NO: 872, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 872; and/or (ii) a heavy chain variable domain having amino acids 20-481 of SEQ ID NO: 874, and a light chain variable domain having amino acids 20-230 of SEQ ID NO: 866. In some embodiments, the heavy chain variable domain may have HC-CDR1, HC-CDR2, and HC-CDR3 with the amino acid sequence of SEQ ID NOs: 876, 878, and 880, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 874. In some embodiments, the light chain variable domain may have LC-CDR1, LC-CDR2, and LC-CDR3 with the amino acid sequence of SEQ ID NOs: 868, 870, and 872, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 866. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 875, 877, 879, 867, 869, 871, 873, and 865, respectively;

(ddd) a PGT121 variant antibody or fragment thereof featured herein includes (i) the following six complementarity determining regions (CDRs): a heavy chain (HC)-CDR1 with the amino acid sequence of SEQ ID NO: 892, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 892; a HC-CDR2 with the amino acid sequence of SEQ ID NO: 894, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 894; a HC-CDR3 with the amino acid sequence of SEQ ID NO: 896, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 896; a light chain (LC)-CDR1 with the amino acid sequence of SEQ ID NO: 884, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 884; a LC-CDR2 with the amino acid sequence of SEQ ID NO: 886, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 886; and a LC-CDR3 with the amino acid sequence of SEQ ID NO: 888, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 888; and/or (ii) a heavy chain variable domain having amino acids 20-481 of SEQ ID NO: 890, and a light chain variable domain having amino acids 20-230 of SEQ ID NO: 882. In some embodiments, the heavy chain variable domain may have HC-CDR1, HC-CDR2, and HC-CDR3 with the amino acid sequence of SEQ ID NOs: 892, 894, and 896, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 890. In some embodiments, the light chain variable domain may have LC-CDR1, LC-CDR2, and LC-CDR3 with the amino acid sequence of SEQ ID NOs: 884, 886, and 888, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 882. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 891, 893, 895, 883, 885, 887, 889, and 881, respectively;

(eee) a PGT121 variant antibody or fragment thereof featured herein includes (i) the following six complementarity determining regions (CDRs): a heavy chain (HC)-CDR1 with the amino acid sequence of SEQ ID NO: 908, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 908; a HC-CDR2 with the amino acid sequence of SEQ ID NO: 910, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 910; a HC-CDR3 with the amino acid sequence of SEQ ID NO: 912, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 912; a light chain (LC)-CDR1 with the amino acid sequence of SEQ ID NO: 900, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 900; a LC-CDR2 with the amino acid sequence of SEQ ID NO: 902, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 902; and a LC-CDR3 with the amino acid sequence of SEQ ID NO: 904, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 904; and/or (ii) a heavy chain variable domain having amino acids 20-481 of SEQ ID NO: 906, and a light chain variable domain having amino acids 20-230 of SEQ ID NO: 898. In some embodiments, the heavy chain variable domain may have HC-CDR1, HC-CDR2, and HC-CDR3 with the amino acid sequence of SEQ ID NOs: 908, 910, and 912, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 906. In some embodiments, the light chain variable domain may have LC-CDR1, LC-CDR2, and LC-CDR3 with the amino acid sequence of SEQ ID NOs: 900, 902, and 904, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 898. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 907, 909, 911, 899, 901, 903, 905, and 897, respectively;

(fff) a PGT121 variant antibody or fragment thereof featured herein includes (i) the following six complementarity determining regions (CDRs): a heavy chain (HC)-CDR1 with the amino acid sequence of SEQ ID NO: 924, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 924; a HC-CDR2 with the amino acid sequence of SEQ ID NO: 926, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 926; a HC-CDR3 with the amino acid sequence of SEQ ID NO: 928, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 928; a light chain (LC)-CDR1 with the amino acid sequence of SEQ ID NO: 916, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 916; a LC-CDR2 with the amino acid sequence of SEQ ID NO: 918, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 918; and a LC-CDR3 with the amino acid sequence of SEQ ID NO: 920, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 920; and/or (ii) a heavy chain variable domain having amino acids 20-481 of SEQ ID NO: 922, and a light chain variable domain having amino acids 20-230 of SEQ ID NO: 914. In some embodiments, the heavy chain variable domain may have HC-CDR1, HC-CDR2, and HC-CDR3 with the amino acid sequence of SEQ ID NOs: 924, 926, and 928, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 922. In some embodiments, the light chain variable domain may have LC-CDR1, LC-CDR2, and LC-CDR3 with the amino acid sequence of SEQ ID NOs: 916, 918, and 920, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 914. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 923, 925, 927, 915, 917, 919, 921, and 913, respectively;

(ggg) a PGT121 variant antibody or fragment thereof featured herein includes (i) the following six complementarity determining regions (CDRs): a heavy chain (HC)-CDR1 with the amino acid sequence of SEQ ID NO: 940, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 940; a HC-CDR2 with the amino acid sequence of SEQ ID NO: 942, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 942; a HC-CDR3 with the amino acid sequence of SEQ ID NO: 944, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 944; a light chain (LC)-CDR1 with the amino acid sequence of SEQ ID NO: 932, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 932; a LC-CDR2 with the amino acid sequence of SEQ ID NO: 934, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 934; and a LC-CDR3 with the amino acid sequence of SEQ ID NO: 936, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 936; and/or (ii) a heavy chain variable domain having amino acids 20-481 of SEQ ID NO: 938, and a light chain variable domain having amino acids 20-230 of SEQ ID NO: 930. In some embodiments, the heavy chain variable domain may have HC-CDR1, HC-CDR2, and HC-CDR3 with the amino acid sequence of SEQ ID NOs: 940, 942, and 944, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 938. In some embodiments, the light chain variable domain may have LC-CDR1, LC-CDR2, and LC-CDR3 with the amino acid sequence of SEQ ID NOs: 932, 934, and 936, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 930. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 939, 941, 943, 931, 933, 935, 937, and 929, respectively;

(hhh) a PGT121 variant antibody or fragment thereof featured herein includes (i) the following six complementarity determining regions (CDRs): a heavy chain (HC)-CDR1 with the amino acid sequence of SEQ ID NO: 956, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 956; a HC-CDR2 with the amino acid sequence of SEQ ID NO: 958, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 958; a HC-CDR3 with the amino acid sequence of SEQ ID NO: 960, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 960; a light chain (LC)-CDR1 with the amino acid sequence of SEQ ID NO: 948, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 948; a LC-CDR2 with the amino acid sequence of SEQ ID NO: 950, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 950; and a LC-CDR3 with the amino acid sequence of SEQ ID NO: 952, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 952; and/or (ii) a heavy chain variable domain having amino acids 20-481 of SEQ ID NO: 954, and a light chain variable domain having amino acids 20-230 of SEQ ID NO: 946. In some embodiments, the heavy chain variable domain may have HC-CDR1, HC-CDR2, and HC-CDR3 with the amino acid sequence of SEQ ID NOs: 956, 958, and 960, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 954. In some embodiments, the light chain variable domain may have LC-CDR1, LC-CDR2, and LC-CDR3 with the amino acid sequence of SEQ ID NOs: 948, 950, and 952, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 946. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 955, 957, 959, 947, 949, 951, 953, and 945, respectively;

(iii) a PGT121 variant antibody or fragment thereof featured herein includes (i) the following six complementarity determining regions (CDRs): a heavy chain (HC)-CDR1 with the amino acid sequence of SEQ ID NO: 972, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 972; a HC-CDR2 with the amino acid sequence of SEQ ID NO: 974, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 974; a HC-CDR3 with the amino acid sequence of SEQ ID NO: 976, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 976; a light chain (LC)-CDR1 with the amino acid sequence of SEQ ID NO: 964, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 964; a LC-CDR2 with the amino acid sequence of SEQ ID NO: 966, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 966; and a LC-CDR3 with the amino acid sequence of SEQ ID NO: 968, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 968; and/or (ii) a heavy chain variable domain having amino acids 20-481 of SEQ ID NO: 970, and a light chain variable domain having amino acids 20-230 of SEQ ID NO: 962. In some embodiments, the heavy chain variable domain may have HC-CDR1, HC-CDR2, and HC-CDR3 with the amino acid sequence of SEQ ID NOs: 972, 974, and 976, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 970. In some embodiments, the light chain variable domain may have LC-CDR1, LC-CDR2, and LC-CDR3 with the amino acid sequence of SEQ ID NOs: 964, 966, and 968, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 962. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 971, 973, 975, 963, 965, 967, 969, and 961, respectively;

(jjj) a PGT121 variant antibody or fragment thereof featured herein includes (i) the following six complementarity determining regions (CDRs): a heavy chain (HC)-CDR1 with the amino acid sequence of SEQ ID NO: 988, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 988; a HC-CDR2 with the amino acid sequence of SEQ ID NO: 990, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 990; a HC-CDR3 with the amino acid sequence of SEQ ID NO: 992, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 992; a light chain (LC)-CDR1 with the amino acid sequence of SEQ ID NO: 980, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 980; a LC-CDR2 with the amino acid sequence of SEQ ID NO: 982, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 982; and a LC-CDR3 with the amino acid sequence of SEQ ID NO: 984, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 984; and/or (ii) a heavy chain variable domain having amino acids 20-481 of SEQ ID NO: 986, and a light chain variable domain having amino acids 20-230 of SEQ ID NO: 978. In some embodiments, the heavy chain variable domain may have HC-CDR1, HC-CDR2, and HC-CDR3 with the amino acid sequence of SEQ ID NOs: 988, 990, and 992, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 986. In some embodiments, the light chain variable domain may have LC-CDR1, LC-CDR2, and LC-CDR3 with the amino acid sequence of SEQ ID NOs: 980, 982, and 984, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 978. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 987, 989, 991, 979, 981, 983, 985, and 977, respectively;

(kkk) a PGT121 variant antibody or fragment thereof featured herein includes (i) the following six complementarity determining regions (CDRs): a heavy chain (HC)-CDR1 with the amino acid sequence of SEQ ID NO: 1004, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1004; a HC-CDR2 with the amino acid sequence of SEQ ID NO: 1006, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1006; a HC-CDR3 with the amino acid sequence of SEQ ID NO: 1008, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1008; and a light chain (LC)-CDR1 with the amino acid sequence of SEQ ID NO: 996, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 996; a LC-CDR2 with the amino acid sequence of SEQ ID NO: 998, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 998; and a LC-CDR3 with the amino acid sequence of SEQ ID NO: 1000, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1000; and/or (ii) a heavy chain variable domain having amino acids 20-481 of SEQ ID NO: 1002, and a light chain variable domain having amino acids 20-230 of SEQ ID NO: 994; the antibody or antigen-binding fragment thereof has a R39Q mutation in the heavy chain variable domain, M87L and N93S mutations in the heavy chain Fc region, and E9Q and H30Q mutations in the light chain variable domain. In some embodiments, the heavy chain variable domain may have HC-CDR1, HC-CDR2, and HC-CDR3 with the amino acid sequence of SEQ ID NOs: 1004, 1006, and 1008, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1002. In some embodiments, the light chain variable domain may have LC-CDR1, LC-CDR2, and LC-CDR3 with the amino acid sequence of SEQ ID NOs: 996, 998, and 1000, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 994. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1003, 1005, 1007, 995, 997, 999, 1001, and 993, respectively;

(lll) a PGT121 variant antibody or fragment thereof featured herein includes (i) the following six complementarity determining regions (CDRs): a heavy chain (HC)-CDR1 with the amino acid sequence of SEQ ID NO: 1020, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1020; a HC-CDR2 with the amino acid sequence of SEQ ID NO: 1022, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1022; a HC-CDR3 with the amino acid sequence of SEQ ID NO: 1024, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1024; a light chain (LC)-CDR1 with the amino acid sequence of SEQ ID NO: 1012, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1012; a LC-CDR2 with the amino acid sequence of SEQ ID NO: 1014, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1014; and a LC-CDR3 with the amino acid sequence of SEQ ID NO: 1016, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1016; and/or (ii) a heavy chain variable domain having amino acids 20-481 of SEQ ID NO: 1018, and a light chain variable domain having amino acids 20-230 of SEQ ID NO: 1010; the antibody or antigen-binding fragment thereof has a R39Q mutation in the heavy chain variable domain, M87L and N93S mutations in the heavy chain Fc region, and H30Q and P61G mutations in the light chain variable domain. In some embodiments, the heavy chain variable domain may have HC-CDR1, HC-CDR2, and HC-CDR3 with the amino acid sequence of SEQ ID NOs: 1020, 1022, and 1024, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1018. In some embodiments, the light chain variable domain may have LC-CDR1, LC-CDR2, and LC-CDR3 with the amino acid sequence of SEQ ID NOs: 1012, 1014, and 1016, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1010. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1019, 1021, 1023, 1011, 1013, 1015, 1017, and 1009, respectively;

(mmm) a PGT121 variant antibody or fragment thereof featured herein includes (i) the following six complementarity determining regions (CDRs): a heavy chain (HC)-CDR1 with the amino acid sequence of SEQ ID NO: 1036, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1036; a HC-CDR2 with the amino acid sequence of SEQ ID NO: 1038, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1038; a HC-CDR3 with the amino acid sequence of SEQ ID NO: 1040, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1040; a light chain (LC)-CDR1 with the amino acid sequence of SEQ ID NO: 1028, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1028; a LC-CDR2 with the amino acid sequence of SEQ ID NO: 1030, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1030; and a LC-CDR3 with the amino acid sequence of SEQ ID NO: 1032, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1032; and/or (ii) a heavy chain variable domain having amino acids 20-481 of SEQ ID NO: 1034, and a light chain variable domain having amino acids 20-230 of SEQ ID NO: 1026; the antibody or antigen-binding fragment thereof has a R39Q mutation in the heavy chain variable domain, M87L and N93S mutations in the heavy chain Fc region, and H30Q and T101K mutations in the light chain variable domain. In some embodiments, the heavy chain variable domain may have HC-CDR1, HC-CDR2, and HC-CDR3 with the amino acid sequence of SEQ ID NOs: 1036, 1038, and 1040, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1034. In some embodiments, the light chain variable domain may have LC-CDR1, LC-CDR2, and LC-CDR3 with the amino acid sequence of SEQ ID NOs: 1028, 1030, and 1032, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1026. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1035, 1037, 1039, 1027, 1029, 1031, 1033, and 1025, respectively;

(nnn) a PGT121 variant antibody or fragment thereof featured herein includes (i) the following six complementarity determining regions (CDRs): a heavy chain (HC)-CDR1 with the amino acid sequence of SEQ ID NO: 1052, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1052; a HC-CDR2 with the amino acid sequence of SEQ ID NO: 1054, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1054; a HC-CDR3 with the amino acid sequence of SEQ ID NO: 1056, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1056; a light chain (LC)-CDR1 with the amino acid sequence of SEQ ID NO: 1044, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1044; a LC-CDR2 with the amino acid sequence of SEQ ID NO: 1046, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1046; and a LC-CDR3 with the amino acid sequence of SEQ ID NO: 1048, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1048; and/or (ii) a heavy chain variable domain having amino acids 20-481 of SEQ ID NO: 1050, and a light chain variable domain having amino acids 20-230 of SEQ ID NO: 1042; the antibody or antigen-binding fragment thereof has R39Q and S40P mutations in the heavy chain variable domain, M87L and N93S mutations in the heavy chain Fc region, and a H30Q mutation in the light chain variable domain. In some embodiments, the heavy chain variable domain may have HC-CDR1, HC-CDR2, and HC-CDR3 with the amino acid sequence of SEQ ID NOs: 1052, 1054, and 1056, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1050. In some embodiments, the light chain variable domain may have LC-CDR1, LC-CDR2, and LC-CDR3 with the amino acid sequence of SEQ ID NOs: 1044, 1046, and 1048, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1042. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1051, 1053, 1055, 1043, 1045, 1047, 1049, and 1041, respectively;

(ooo) a PGT121 variant antibody or fragment thereof featured herein includes (i) the following six complementarity determining regions (CDRs): a heavy chain (HC)-CDR1 with the amino acid sequence of SEQ ID NO: 1068, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1068; a HC-CDR2 with the amino acid sequence of SEQ ID NO: 1070, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1070; a HC-CDR3 with the amino acid sequence of SEQ ID NO: 1072, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1072; a light chain (LC)-CDR1 with the amino acid sequence of SEQ ID NO: 1060, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1060; a LC-CDR2 with the amino acid sequence of SEQ ID NO: 1062, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1062; and a LC-CDR3 with the amino acid sequence of SEQ ID NO: 1064, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1064; and/or (ii) a heavy chain variable domain having amino acids 20-481 of SEQ ID NO: 1066, and a light chain variable domain having amino acids 20-230 of SEQ ID NO: 1058; the antibody or antigen-binding fragment thereof has R39Q and V83S mutations in the heavy chain variable domain, M87L and N93S mutations in the heavy chain Fc region, and a H30Q mutation in the light chain variable domain. In some embodiments, the heavy chain variable domain may have HC-CDR1, HC-CDR2, and HC-CDR3 with the amino acid sequence of SEQ ID NOs: 1068, 1070, and 1072, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1066. In some embodiments, the light chain variable domain may have LC-CDR1, LC-CDR2, and LC-CDR3 with the amino acid sequence of SEQ ID NOs: 1060, 1062, and 1064, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1058. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1067, 1069, 1071, 1059, 1061, 1063, 1065, and 1057, respectively;

(ppp) a PGT121 variant antibody or fragment thereof featured herein includes (i) the following six complementarity determining regions (CDRs): a heavy chain (HC)-CDR1 with the amino acid sequence of SEQ ID NO: 1084, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1084; a HC-CDR2 with the amino acid sequence of SEQ ID NO: 1086, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1086; a HC-CDR3 with the amino acid sequence of SEQ ID NO: 1088, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1088; a light chain (LC)-CDR1 with the amino acid sequence of SEQ ID NO: 1076, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1076; a LC-CDR2 with the amino acid sequence of SEQ ID NO: 1078, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1078; and a LC-CDR3 with the amino acid sequence of SEQ ID NO: 1080, or 10 or fewer (e.g., 9, 8, 7, 6, 5, 4, 3, 2 or 1) amino acid modification (s) (e.g., insertion, deletion, or substitution) relative to the amino acid sequence of SEQ ID NO: 1080; and/or (ii) a heavy chain variable domain having amino acids 20-481 of SEQ ID NO: 1082, and a light chain variable domain having amino acids 20-230 of SEQ ID NO: 1074; the antibody or antigen-binding fragment thereof has R39Q and K92V mutations in the heavy chain variable domain, M87L and N93S mutations in the heavy chain Fc region, and a H30Q mutation in the light chain variable domain. In some embodiments, the heavy chain variable domain may have HC-CDR1, HC-CDR2, and HC-CDR3 with the amino acid sequence of SEQ ID NOs: 1084, 1086, and 1088, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1082. In some embodiments, the light chain variable domain may have LC-CDR1, LC-CDR2, and LC-CDR3 with the amino acid sequence of SEQ ID NOs: 1076, 1078, and 1080, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1074. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1083, 1085, 1087, 1075, 1077, 1079, 1081, and 1073, respectively;

(qqq) a PGT121 variant antibody or fragment thereof featured herein includes (i) the following six complementarity determining regions (CDRs): a heavy chain (HC)-CDR1 with the amino acid sequence of SEQ ID NO: 1100, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1100; a HC-CDR2 with the amino acid sequence of SEQ ID NO: 1102, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1102; a HC-CDR3 with the amino acid sequence of SEQ ID NO: 1104, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1104; a light chain (LC)-CDR1 with the amino acid sequence of SEQ ID NO: 1092, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1092; a LC-CDR2 with the amino acid sequence of SEQ ID NO: 1094, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1094; and a LC-CDR3 with the amino acid sequence of SEQ ID NO: 1096, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1096; and/or (ii) a heavy chain variable domain having amino acids 20-481 of SEQ ID NO: 1098, and a light chain variable domain having amino acids 20-230 of SEQ ID NO: 1090; the antibody or antigen-binding fragment thereof has R39Q and S40P mutations in the heavy chain variable domain, M87L and N93S mutations in the heavy chain Fc region, and H30Q and E9Q mutations in the light chain variable domain. In some embodiments, the heavy chain variable domain may have HC-CDR1, HC-CDR2, and HC-CDR3 with the amino acid sequence of SEQ ID NOs: 1100, 1102, and 1104, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1098. In some embodiments, the light chain variable domain may have LC-CDR1, LC-CDR2, and LC-CDR3 with the amino acid sequence of SEQ ID NOs: 1092, 1094, and 1096, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1090. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1099, 1101, 1103, 1091, 1093, 1095, 1097, and 1089, respectively;

(rrr) a PGT121 variant antibody or fragment thereof featured herein includes (i) the following six complementarity determining regions (CDRs): a heavy chain (HC)-CDR1 with the amino acid sequence of SEQ ID NO: 1116, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1116; a HC-CDR2 with the amino acid sequence of SEQ ID NO: 1118, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1118; a HC-CDR3 with the amino acid sequence of SEQ ID NO: 1120, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1120; a light chain (LC)-CDR1 with the amino acid sequence of SEQ ID NO: 1108, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1108; a LC-CDR2 with the amino acid sequence of SEQ ID NO: 1110, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1110; and a LC-CDR3 with the amino acid sequence of SEQ ID NO: 1112, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1112; and/or (ii) a heavy chain variable domain having amino acids 20-481 of SEQ ID NO: 1114, and a light chain variable domain having amino acids 20-230 of SEQ ID NO: 1106; the antibody or antigen-binding fragment thereof has R39Q and K92V mutations in the heavy chain variable domain, M87L and N93S mutations in the heavy chain Fc region, and H30Q and E9Q mutations in the light chain variable domain. In some embodiments, the heavy chain variable domain may have HC-CDR1, HC-CDR2, and HC-CDR3 with the amino acid sequence of SEQ ID NOs: 1116, 1118, and 1120, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1114. In some embodiments, the light chain variable domain may have LC-CDR1, LC-CDR2, and LC-CDR3 with the amino acid sequence of SEQ ID NOs: 1108, 1110, and 1112, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1106. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1115, 1117, 1119, 1107, 1109, 1111, 1113, and 1105, respectively;

(sss) a PGT121 variant antibody or fragment thereof featured herein includes (i) the following six complementarity determining regions (CDRs): a heavy chain (HC)-CDR1 with the amino acid sequence of SEQ ID NO: 1132, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1132; a HC-CDR2 with the amino acid sequence of SEQ ID NO: 1134, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1134; a HC-CDR3 with the amino acid sequence of SEQ ID NO: 1136, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1136; a light chain (LC)-CDR1 with the amino acid sequence of SEQ ID NO: 1124, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1124; a LC-CDR2 with the amino acid sequence of SEQ ID NO: 1126, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1126; and a LC-CDR3 with the amino acid sequence of SEQ ID NO: 1128, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1128; and/or (ii) a heavy chain variable domain having amino acids 20-481 of SEQ ID NO: 1130, and a light chain variable domain having amino acids 20-230 of SEQ ID NO: 1122; the antibody or antigen-binding fragment thereof has a R39Q mutation in the heavy chain variable domain, M87L and N93S mutations in the heavy chain Fc region, and H30Q, P61G and T101K mutations in the light chain variable domain. In some embodiments, the heavy chain variable domain may have HC-CDR1, HC-CDR2, and HC-CDR3 with the amino acid sequence of SEQ ID NOs: 1132, 1134, and 1136, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1130. In some embodiments, the light chain variable domain may have LC-CDR1, LC-CDR2, and LC-CDR3 with the amino acid sequence of SEQ ID NOs: 1124, 1126, and 1128, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1122. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1131, 1133, 1135, 1123, 1125, 1127, 1129, and 1121, respectively;

(ttt) a PGT121 variant antibody or fragment thereof featured herein includes (i) the following six complementarity determining regions (CDRs): a heavy chain (HC)-CDR1 with the amino acid sequence of SEQ ID NO: 1148, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1148; a HC-CDR2 with the amino acid sequence of SEQ ID NO: 1150, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1150; a HC-CDR3 with the amino acid sequence of SEQ ID NO: 1152, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1152; a light chain (LC)-CDR1 with the amino acid sequence of SEQ ID NO: 1140, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1140; a LC-CDR2 with the amino acid sequence of SEQ ID NO: 1142, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1142; and a LC-CDR3 with the amino acid sequence of SEQ ID NO: 1144, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1144; and/or (ii) a heavy chain variable domain having amino acids 20-481 of SEQ ID NO: 1146, and a light chain variable domain having amino acids 20-230 of SEQ ID NO: 1138; the antibody or antigen-binding fragment thereof has R39Q and V83S mutations in the heavy chain variable domain, M87L and N93S mutations in the heavy chain Fc region, and H30Q and P61G mutations in the light chain variable domain. In some embodiments, the heavy chain variable domain may have HC-CDR1, HC-CDR2, and HC-CDR3 with the amino acid sequence of SEQ ID NOs: 1148, 1150, and 1152, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1146. In some embodiments, the light chain variable domain may have LC-CDR1, LC-CDR2, and LC-CDR3 with the amino acid sequence of SEQ ID NOs: 1140, 1142, and 1144, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1138. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1147, 1149, 1151, 1139, 1141, 1143, 1145, and 1137, respectively;

(uuu) a PGT121 variant antibody or fragment thereof featured herein includes (i) the following six complementarity determining regions (CDRs): a heavy chain (HC)-CDR1 with the amino acid sequence of SEQ ID NO: 1164, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1164; a HC-CDR2 with the amino acid sequence of SEQ ID NO: 1166, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1166; a HC-CDR3 with the amino acid sequence of SEQ ID NO: 1168, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1168; a light chain (LC)-CDR1 with the amino acid sequence of SEQ ID NO: 1156, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1156; a LC-CDR2 with the amino acid sequence of SEQ ID NO: 1158, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1158; and a LC-CDR3 with the amino acid sequence of SEQ ID NO: 1160, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1160; the antibody or antigen-binding fragment thereof has a heavy chain variable domain having amino acids 20-481 of SEQ ID NO: 1162, and a light chain variable domain having amino acids 20-230 of SEQ ID NO: 1154; the antibody or antigen-binding fragment thereof has R39Q and V83S mutations in the heavy chain variable domain, M87L and N93S mutations in the heavy chain Fc region, and H30Q and T101K mutations in the light chain variable domain. In some embodiments, the heavy chain variable domain may have HC-CDR1, HC-CDR2, and HC-CDR3 with the amino acid sequence of SEQ ID NOs: 1164, 1166, and 1168, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1162. In some embodiments, the light chain variable domain may have LC-CDR1, LC-CDR2, and LC-CDR3 with the amino acid sequence of SEQ ID NOs: 1156, 1158, and 1160, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1154. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1163, 1165, 1167, 1155, 1157, 1159, 1161, and 1153, respectively;

(vvv) a PGT121 variant antibody or fragment thereof featured herein includes (i) the following six complementarity determining regions (CDRs): a heavy chain (HC)-CDR1 with the amino acid sequence of SEQ ID NO: 1180, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1180; a HC-CDR2 with the amino acid sequence of SEQ ID NO: 1182, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1182; a HC-CDR3 with the amino acid sequence of SEQ ID NO: 1184, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1184; a light chain (LC)-CDR1 with the amino acid sequence of SEQ ID NO: 1172, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1172; a LC-CDR2 with the amino acid sequence of SEQ ID NO: 1174, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1174; and a LC-CDR3 with the amino acid sequence of SEQ ID NO: 1176, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1176; and/or (ii) a heavy chain variable domain having amino acids 20-481 of SEQ ID NO: 1178, and a light chain variable domain having amino acids 20-230 of SEQ ID NO: 1170; the antibody or antigen-binding fragment thereof has R39Q, S40P and K92V mutations in the heavy chain variable domain, M87L and N93S mutations in the heavy chain Fc region, and a H30Q mutation in the light chain variable domain. In some embodiments, the heavy chain variable domain may have HC-CDR1, HC-CDR2, and HC-CDR3 with the amino acid sequence of SEQ ID NOs: 1180, 1182, and 1184, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1178. In some embodiments, the light chain variable domain may have LC-CDR1, LC-CDR2, and LC-CDR3 with the amino acid sequence of SEQ ID NOs: 1172, 1174, and 1176, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1170. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1179, 1181, 1183, 1171, 1173, 1175, 1177, and 1169, respectively;

(www) a PGT121 variant antibody or fragment thereof featured herein includes (i) the following six complementarity determining regions (CDRs): a heavy chain (HC)-CDR1 with the amino acid sequence of SEQ ID NO: 1196, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1196; a HC-CDR2 with the amino acid sequence of SEQ ID NO: 1198, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1198; a HC-CDR3 with the amino acid sequence of SEQ ID NO: 1200, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1200; a light chain (LC)-CDR1 with the amino acid sequence of SEQ ID NO: 1188, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1188; a LC-CDR2 with the amino acid sequence of SEQ ID NO: 1190, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1190; and a LC-CDR3 with the amino acid sequence of SEQ ID NO: 1192, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1192; and/or (ii) a heavy chain variable domain having amino acids 20-481 of SEQ ID NO: 1194, and a light chain variable domain having amino acids 20-230 of SEQ ID NO: 1186; the antibody or antigen-binding fragment thereof has R39Q, S40P and K92V mutations in the heavy chain variable domain, M87L and N93S mutations in the heavy chain Fc region, and H30Q and E9Q mutations in the light chain variable domain. In some embodiments, the heavy chain variable domain may have HC-CDR1, HC-CDR2, and HC-CDR3 with the amino acid sequence of SEQ ID NOs: 1196, 1198, and 1200, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1194. In some embodiments, the light chain variable domain may have LC-CDR1, LC-CDR2, and LC-CDR3 with the amino acid sequence of SEQ ID NOs: 1188, 1190, and 1192, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1186. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1195, 1197, 1199, 1187, 1189, 1191, 1193, and 1185, respectively;

(xxx) a PGT121 variant antibody or fragment thereof featured herein includes (i) the following six complementarity determining regions (CDRs): a heavy chain (HC)-CDR1 with the amino acid sequence of SEQ ID NO: 1212, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1212; a HC-CDR2 with the amino acid sequence of SEQ ID NO: 1214, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1214; a HC-CDR3 with the amino acid sequence of SEQ ID NO: 1216, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1216; a light chain (LC)-CDR1 with the amino acid sequence of SEQ ID NO: 1204, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1204; a LC-CDR2 with the amino acid sequence of SEQ ID NO: 1206, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1206; and a LC-CDR3 with the amino acid sequence of SEQ ID NO: 1208, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1208; and/or (ii) a heavy chain variable domain having amino acids 20-481 of SEQ ID NO: 1210, and a light chain variable domain having amino acids 20-230 of SEQ ID NO: 1202; the antibody or antigen-binding fragment thereof has R39Q and V83S mutations in the heavy chain variable domain, M87L and N93S mutations in the heavy chain Fc region, and H30Q, P61G and T101K mutations in the light chain variable domain. In some embodiments, the heavy chain variable domain may have HC-CDR1, HC-CDR2, and HC-CDR3 with the amino acid sequence of SEQ ID NOs: 1212, 1214, and 1216, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1210. In some embodiments, the light chain variable domain may have LC-CDR1, LC-CDR2, and LC-CDR3 with the amino acid sequence of SEQ ID NOs: 1204, 1206, and 1208, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1202. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1211, 1213, 1215, 1203, 1205, 1207, 1209, and 1201, respectively;

(yyy) a PGT121 variant antibody or fragment thereof featured herein includes (i) the following six complementarity determining regions (CDRs): a heavy chain (HC)-CDR1 with the amino acid sequence of SEQ ID NO: 1228, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1228; a HC-CDR2 with the amino acid sequence of SEQ ID NO: 1230, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1230; a HC-CDR3 with the amino acid sequence of SEQ ID NO: 1232, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1232; a light chain (LC)-CDR1 with the amino acid sequence of SEQ ID NO: 1220, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1220; a LC-CDR2 with the amino acid sequence of SEQ ID NO: 1222, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1222; and a LC-CDR3 with the amino acid sequence of SEQ ID NO: 1224, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1224; and/or (ii) a heavy chain variable domain having amino acids 20-481 of SEQ ID NO: 1226, and a light chain variable domain having amino acids 20-230 of SEQ ID NO: 1218; the antibody or antigen-binding fragment thereof has R39Q, V83S and K92V mutations in the heavy chain variable domain, M87L and N93S mutations in the heavy chain Fc region, and H30Q, P61G and E9Q mutations in the light chain variable domain. In some embodiments, the heavy chain variable domain may have HC-CDR1, HC-CDR2, and HC-CDR3 with the amino acid sequence of SEQ ID NOs: 1228, 1230, and 1232, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1226. In some embodiments, the light chain variable domain may have LC-CDR1, LC-CDR2, and LC-CDR3 with the amino acid sequence of SEQ ID NOs: 1220, 1222, and 1224, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1218. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1227, 1229, 1231, 1219, 1221, 1223, 1225, and 1217, respectively;

(zzz) a PGT121 variant antibody or fragment thereof featured herein includes (i) the following six complementarity determining regions (CDRs): a heavy chain (HC)-CDR1 with the amino acid sequence of SEQ ID NO: 1244, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1244; a HC-CDR2 with the amino acid sequence of SEQ ID NO: 1246, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1246; a HC-CDR3 with the amino acid sequence of SEQ ID NO: 1248, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1248; a light chain (LC)-CDR1 with the amino acid sequence of SEQ ID NO: 1236, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1236; a LC-CDR2 with the amino acid sequence of SEQ ID NO: 1238, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1238; and a LC-CDR3 with the amino acid sequence of SEQ ID NO: 1240, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1240; and/or (ii) a heavy chain variable domain having amino acids 20-481 of SEQ ID NO: 1242, and a light chain variable domain having amino acids 20-230 of SEQ ID NO: 1234; the antibody or antigen-binding fragment thereof has R39Q, V83S and K92V mutations in the heavy chain variable domain, M87L and N93S mutations in the heavy chain Fc region, and H30Q and P61G mutations in the light chain variable domain. In some embodiments, the heavy chain variable domain may have HC-CDR1, HC-CDR2, and HC-CDR3 with the amino acid sequence of SEQ ID NOs: 1244, 1246, and 1248, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1242. In some embodiments, the light chain variable domain may have LC-CDR1, LC-CDR2, and LC-CDR3 with the amino acid sequence of SEQ ID NOs: 1236, 1238, and 1240, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1234. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1243, 1245, 1247, 1235, 1237, 1239, 1241, and 1233, respectively;

(aaaa) a PGT121 variant antibody or fragment thereof featured herein includes (i) the following six complementarity determining regions (CDRs): a heavy chain (HC)-CDR1 with the amino acid sequence of SEQ ID NO: 1260, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1260; a HC-CDR2 with the amino acid sequence of SEQ ID NO: 1262, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1262; a HC-CDR3 with the amino acid sequence of SEQ ID NO: 1264, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1264; a light chain (LC)-CDR1 with the amino acid sequence of SEQ ID NO: 1252, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1252; a LC-CDR2 with the amino acid sequence of SEQ ID NO: 1254, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1254; and a LC-CDR3 with the amino acid sequence of SEQ ID NO: 1256, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1256; the antibody or antigen-binding fragment thereof has a heavy chain variable domain having amino acids 20-481 of SEQ ID NO: 1258, and a light chain variable domain having amino acids 20-230 of SEQ ID NO: 1250; the antibody or antigen-binding fragment thereof has R39Q and N124Q mutations in the heavy chain variable domain, M87L and N93S mutations in the heavy chain Fc region, and H30Q and P61G mutations in the light chain variable domain. In some embodiments, the heavy chain variable domain may have HC-CDR1, HC-CDR2, and HC-CDR3 with the amino acid sequence of SEQ ID NOs: 1260, 1262, and 1264, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1258. In some embodiments, the light chain variable domain may have LC-CDR1, LC-CDR2, and LC-CDR3 with the amino acid sequence of SEQ ID NOs: 1252, 1254, and 1256, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1250. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1259, 1261, 1263, 1251, 1253, 1255, 1257, and 1249, respectively;

(bbbb) a PGT121 variant antibody or fragment thereof featured herein includes (i) the following six complementarity determining regions (CDRs): a heavy chain (HC)-CDR1 with the amino acid sequence of SEQ ID NO: 1276, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1276; a HC-CDR2 with the amino acid sequence of SEQ ID NO: 1278, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1278; a HC-CDR3 with the amino acid sequence of SEQ ID NO: 1280, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1280; a light chain (LC)-CDR1 with the amino acid sequence of SEQ ID NO: 1268, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1268; a LC-CDR2 with the amino acid sequence of SEQ ID NO: 1270, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1270; and a LC-CDR3 with the amino acid sequence of SEQ ID NO: 1272, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1272; and/or (ii) a heavy chain variable domain having amino acids 20-481 of SEQ ID NO: 1274, and a light chain variable domain having amino acids 20-230 of SEQ ID NO: 1266; the antibody or antigen-binding fragment thereof has R39Q, V83S and N124Q mutations in the heavy chain variable domain, M87L and N93S mutations in the heavy chain Fc region, and a H30Q mutation in the light chain variable domain. In some embodiments, the heavy chain variable domain may have HC-CDR1, HC-CDR2, and HC-CDR3 with the amino acid sequence of SEQ ID NOs: 1276, 1278, and 1280, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1274. In some embodiments, the light chain variable domain may have LC-CDR1, LC-CDR2, and LC-CDR3 with the amino acid sequence of SEQ ID NOs: 1268, 1270, and 1272, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1266. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1275, 1277, 1279, 1267, 1269, 1271, 1273, and 1265, respectively;

(cccc) a PGT121 variant antibody or fragment thereof featured herein includes (i) the following six complementarity determining regions (CDRs): a heavy chain (HC)-CDR1 with the amino acid sequence of SEQ ID NO: 1292, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1292; a HC-CDR2 with the amino acid sequence of SEQ ID NO: 1294, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1294; a HC-CDR3 with the amino acid sequence of SEQ ID NO: 1296, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1296; a light chain (LC)-CDR1 with the amino acid sequence of SEQ ID NO: 1284, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1284; a LC-CDR2 with the amino acid sequence of SEQ ID NO: 1286, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1286; and a LC-CDR3 with the amino acid sequence of SEQ ID NO: 1288, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1288; and/or (ii) a heavy chain variable domain having amino acids 20-481 of SEQ ID NO: 1290, and a light chain variable domain having amino acids 20-230 of SEQ ID NO: 1282; the antibody or antigen-binding fragment thereof has R39Q and N124Q mutations in the heavy chain variable domain, M87L and N93S mutations in the heavy chain Fc region, and H30Q and T101K mutations in the light chain variable domain. In some embodiments, the heavy chain variable domain may have HC-CDR1, HC-CDR2, and HC-CDR3 with the amino acid sequence of SEQ ID NOs: 1292, 1294, and 1296, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1290. In some embodiments, the light chain variable domain may have LC-CDR1, LC-CDR2, and LC-CDR3 with the amino acid sequence of SEQ ID NOs: 1284, 1286, and 1288, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1282. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1291, 1293, 1295, 1283, 1285, 1287, 1289, and 1281, respectively;

(dddd) a PGT121 variant antibody or fragment thereof featured herein includes (i) the following six complementarity determining regions (CDRs): a heavy chain (HC)-CDR1 with the amino acid sequence of SEQ ID NO: 1308, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1308; a HC-CDR2 with the amino acid sequence of SEQ ID NO: 1310, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1310; a HC-CDR3 with the amino acid sequence of SEQ ID NO: 1312, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1312; a light chain (LC)-CDR1 with the amino acid sequence of SEQ ID NO: 1300, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1300; a LC-CDR2 with the amino acid sequence of SEQ ID NO: 1302, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1302; and a LC-CDR3 with the amino acid sequence of SEQ ID NO: 1304, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1304; and/or (ii) a heavy chain variable domain having amino acids 20-481 of SEQ ID NO: 1306, and a light chain variable domain having amino acids 20-230 of SEQ ID NO: 1298; the antibody or antigen-binding fragment thereof has R39Q, V83S and N124Q mutations in the heavy chain variable domain, M87L and N93S mutations in the heavy chain Fc region, and H30Q and T101K mutations in the light chain variable domain. In some embodiments, the heavy chain variable domain may have HC-CDR1, HC-CDR2, and HC-CDR3 with the amino acid sequence of SEQ ID NOs: 1308, 1310, and 1312, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1306. In some embodiments, the light chain variable domain may have LC-CDR1, LC-CDR2, and LC-CDR3 with the amino acid sequence of SEQ ID NOs: 1300, 1302, and 1304, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1298. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1307, 1309, 1311, 1299, 1301, 1303, 1305, and 1297, respectively;

(eeee) a PGT121 variant antibody or fragment thereof featured herein includes (i) the following six complementarity determining regions (CDRs): a heavy chain (HC)-CDR1 with the amino acid sequence of SEQ ID NO: 1324, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1324; a HC-CDR2 with the amino acid sequence of SEQ ID NO: 1326, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1326; a HC-CDR3 with the amino acid sequence of SEQ ID NO: 1328, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1328; a light chain (LC)-CDR1 with the amino acid sequence of SEQ ID NO: 1316, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1316; a LC-CDR2 with the amino acid sequence of SEQ ID NO: 1318, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1318; and a LC-CDR3 with the amino acid sequence of SEQ ID NO: 1320, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1320; and/or (ii) a heavy chain variable domain having amino acids 20-481 of SEQ ID NO: 1322, and a light chain variable domain having amino acids 20-230 of SEQ ID NO: 1314; the antibody or antigen-binding fragment thereof has R39Q and N124Q mutations in the heavy chain variable domain, M87L and N93S mutations in the heavy chain Fc region, and H30Q, P61G and T101K mutations in the light chain variable domain. In some embodiments, the heavy chain variable domain may have HC-CDR1, HC-CDR2, and HC-CDR3 with the amino acid sequence of SEQ ID NOs: 1324, 1326, and 1328, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1322. In some embodiments, the light chain variable domain may have LC-CDR1, LC-CDR2, and LC-CDR3 with the amino acid sequence of SEQ ID NOs: 1316, 1318, and 1320, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1314. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1323, 1325, 1327, 1315, 1317, 1319, 1321, and 1313, respectively;

(ffff) a PGT121 variant antibody or fragment thereof featured herein includes (i) the following six complementarity determining regions (CDRs): a heavy chain (HC)-CDR1 with the amino acid sequence of SEQ ID NO: 1340, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1340; a HC-CDR2 with the amino acid sequence of SEQ ID NO: 1342, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1342; a HC-CDR3 with the amino acid sequence of SEQ ID NO: 1344, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1344; a light chain (LC)-CDR1 with the amino acid sequence of SEQ ID NO: 1332, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1332; a LC-CDR2 with the amino acid sequence of SEQ ID NO: 1334, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1334; and a LC-CDR3 with the amino acid sequence of SEQ ID NO: 1336, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1336; and/or (ii) a heavy chain variable domain having amino acids 20-481 of SEQ ID NO: 1338, and a light chain variable domain having amino acids 20-230 of SEQ ID NO: 1330; the antibody or antigen-binding fragment thereof has R39Q, V83S and N124Q mutations in the heavy chain variable domain, M87L and N93S mutations in the heavy chain Fc region, and H30Q and P61G mutations in the light chain variable domain. In some embodiments, the heavy chain variable domain may have HC-CDR1, HC-CDR2, and HC-CDR3 with the amino acid sequence of SEQ ID NOs: 1340, 1342, and 1344, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1338. In some embodiments, the light chain variable domain may have LC-CDR1, LC-CDR2, and LC-CDR3 with the amino acid sequence of SEQ ID NOs: 1332, 1334, and 1336, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1330. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1339, 1341, 1343, 1331, 1333, 1335, 1337, and 1329, respectively;

(gggg) a PGT121 variant antibody or fragment thereof featured herein includes (i) the following six complementarity determining regions (CDRs): a heavy chain (HC)-CDR1 with the amino acid sequence of SEQ ID NO: 1356, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1356; a HC-CDR2 with the amino acid sequence of SEQ ID NO: 1358, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1358; a HC-CDR3 with the amino acid sequence of SEQ ID NO: 1360, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1360; a light chain (LC)-CDR1 with the amino acid sequence of SEQ ID NO: 1348, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1348; a LC-CDR2 with the amino acid sequence of SEQ ID NO: 1350, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1350; and a LC-CDR3 with the amino acid sequence of SEQ ID NO: 1352, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1352; and/or (ii) a heavy chain variable domain having amino acids 20-481 of SEQ ID NO: 1354, and a light chain variable domain having amino acids 20-230 of SEQ ID NO: 1346; the antibody or antigen-binding fragment thereof has R39Q, V83S and N124Q mutations in the heavy chain variable domain, M87L and N93S mutations in the heavy chain Fc region, and H30Q, P61G and T101K mutations in the light chain variable domain. In some embodiments, the heavy chain variable domain may have HC-CDR1, HC-CDR2, and HC-CDR3 with the amino acid sequence of SEQ ID NOs: 1356, 1358, and 1360, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1354. In some embodiments, the light chain variable domain may have LC-CDR1, LC-CDR2, and LC-CDR3 with the amino acid sequence of SEQ ID NOs: 1348, 1350, and 1352, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1346. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1355, 1357, 1359, 1347, 1349, 1351, 1353, and 1345, respectively;

(hhhh) a PGT121 variant antibody or fragment thereof featured herein includes (i) the following six complementarity determining regions (CDRs): a heavy chain (HC)-CDR1 with the amino acid sequence of SEQ ID NO: 1372, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1372; a HC-CDR2 with the amino acid sequence of SEQ ID NO: 1374, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1374; a HC-CDR3 with the amino acid sequence of SEQ ID NO: 1376, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1376; a light chain (LC)-CDR1 with the amino acid sequence of SEQ ID NO: 1364, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1364; a LC-CDR2 with the amino acid sequence of SEQ ID NO: 1366, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1366; and a LC-CDR3 with the amino acid sequence of SEQ ID NO: 1368, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1368; and/or (ii) a heavy chain variable domain having amino acids 20-481 of SEQ ID NO: 1370, and a light chain variable domain having amino acids 20-230 of SEQ ID NO: 1362; the antibody or antigen-binding fragment thereof has R39Q, S40P, V83S, K92V and N124Q mutations in the heavy chain variable domain, M87L and N93S mutations in the heavy chain Fc region, and H30Q and P61G mutations in the light chain variable domain. In some embodiments, the heavy chain variable domain may have HC-CDR1, HC-CDR2, and HC-CDR3 with the amino acid sequence of SEQ ID NOs: 1372, 1374, and 1376, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1370. In some embodiments, the light chain variable domain may have LC-CDR1, LC-CDR2, and LC-CDR3 with the amino acid sequence of SEQ ID NOs: 1364, 1366, and 1368, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1362. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1371, 1373, 1375, 1363, 1365, 1367, 1369, and 1361, respectively;

(iiii) a PGT121 variant antibody or fragment thereof featured herein includes (i) the following six complementarity determining regions (CDRs): a heavy chain (HC)-CDR1 with the amino acid sequence of SEQ ID NO: 1388, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1388; a HC-CDR2 with the amino acid sequence of SEQ ID NO: 1390, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1390; a HC-CDR3 with the amino acid sequence of SEQ ID NO: 1392, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1392; a light chain (LC)-CDR1 with the amino acid sequence of SEQ ID NO: 1380, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1380; a LC-CDR2 with the amino acid sequence of SEQ ID NO: 1382, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1382; and a LC-CDR3 with the amino acid sequence of SEQ ID NO: 1384, or 10 or fewer (e.g., 9, 8, 7, 6, 5, 4, 3, 2 or 1) amino acid modification(s) (e.g., insertion, deletion, or substitution) relative to the amino acid sequence of SEQ ID NO: 1384; and/or (ii) a heavy chain variable domain having amino acids 20-481 of SEQ ID NO: 1386, and a light chain variable domain having amino acids 20-230 of SEQ ID NO: 1378; the antibody or antigen-binding fragment thereof has R39Q, V83S, K92V and N124Q mutations in the heavy chain variable domain, M87L and N93S mutations in the heavy chain Fc region, and H30Q, E9Q and P61G mutations in the light chain variable domain. In some embodiments, the heavy chain variable domain may have HC-CDR1, HC-CDR2, and HC-CDR3 with the amino acid sequence of SEQ ID NOs: 1388, 1390, and 1392, and a framework region with 10 or fewer (e.g., 9, 8, 7, 6, 5, 4, 3, 2 or 1) amino acid modification(s) (e.g., insertion, deletion, or substitution) relative to the sequence of amino acids 20-481 of SEQ ID NO: 1386. In some embodiments, the light chain variable domain may have LC-CDR1, LC-CDR2, and LC-CDR3 with the amino acid sequence of SEQ ID NOs: 1380, 1382, and 1384, and a framework region with 10 or fewer (e.g., 9, 8, 7, 6, 5, 4, 3, 2 or 1) amino acid modification(s) (e.g., insertion, deletion, or substitution) relative to the sequence of amino acids 20-230 of SEQ ID NO: 1378. In particular embodiments, the HC-CDR1, the HC-CDR2, the HC-CDR3, the LC-CDR1, the LC-CDR2, the LC-CDR3, the heavy chain variable domain, and the light chain variable domain of the antibody or antigen-binding fragment thereof are encoded by the nucleotide sequences of SEQ ID NOs: 1387, 1389, 1391, 1379, 1381, 1383, 1385, and 1377, respectively.

For manufacturing an antibody or antigen-binding fragment thereof of (a)-(iiii) above (e.g., using an expression system), the heavy and light chain amino acid sequences noted above may include a signal peptide. The signal peptide corresponds to residues 1-19 of the sequences noted above. During maturation, the signal peptide is cleaved. Hence, the mature form of the antibody or antigen-binding fragment thereof lacks the first 1-19 amino acids of the sequence of the respective heavy and light chain domain. The residue numbering corresponds to the amino acid position of the mature linear sequence for the heavy and light chain variable domains of the antibodies described herein, which excludes the signal peptide sequence (amino acids 1-19). For example, position 1 of the mature linear sequence of the light chain variable domain of MS-22 begins at amino acid position 20 of SEQ ID NO: 18. Position 20 of SEQ ID NO: 18 corresponds to the S1P substitution.

In specific embodiments, the PGT121 variant antibody or antigen-binding fragment thereof featured herein may be selected from the group consisting of the aforementioned: (b), (c), (d), (e), (f), (g), (h), (i), (j), (k), (l), (m), (n), (o), (p), (q), (r), (s), (t), (u), (v), (w), (x), (y), (dd), (ee), (hh), (kkk), (lll), (mmm), (nnn), (ooo), (ppp), (qqq), (rrr), (sss), (ttt), (uuu), (vvv), (www), (xxx), (yyy), (zzz), (aaaa), (bbbb), (cccc), (dddd), (eeee), (ffff), (gggg), (hhhh), and (iiii). Preferentially, the PGT121 variant antibody or antigen-binding fragment thereof featured herein may be selected from the group consisting of the aforementioned: (kkk), (lll), (mmm), (nnn), (ooo), (ppp), (qqq), (rrr), (sss), (ttt), (uuu), (vvv), (www), (xxx), (yyy), (zzz), (aaaa), (bbbb), (cccc), (dddd), (eeee), (ffff), (gggg), (hhhh), and (iiii).

In specific embodiments, the PGT121 variant antibody or antigen-binding fragment thereof featured herein may be selected from the group consisting of the following from Tables 1 and 2: MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445. Preferentially, the PGT121 variant antibody or antigen-binding fragment thereof featured herein may be selected from the group consisting of the following from Table 2: MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445.

II. Design of the Antibody Variant Antibodies

Antibody variants (e.g., PGT121 variant antibodies) or antigen-binding fragments thereof, described herein may be produced by an optimization process. The optimization process may be broken up into different stages with the first being identification of single residues in the framework region that may be responsible for destabilization of the native PGT121 antibody. A series of variants can be produced by transient expression (e.g., transient expression in Human Embryonic Kidney 293 (HEK293) or Chinese Hamster Ovary (CHO) cells), each containing a single residue modification of amino acids, or in a few variants, combinations of amino acids based on proximity to each other (e.g., one or more of the Round-1 variants of Table 1). These variants may be characterized for retention of neutralization activity (e.g., neutralization activity against pseudoviruses of human immunodeficiency virus (HIV), such as RHPA4259.7, Du172.17, CNE52, 0260.v5.c36, SC05.8C11.2344, and Ce1176_A3) and for desired biophysical characteristics (e.g., low-pH stability, solubility, thermal stability, chemical unfolding, and reduced aggregation).

We identified several single residues at the light chain/heavy chain interface that significantly reduce low-pH instability (e.g., instability at pH 3.5, pH3.4, or pH 3.3) of the native PGT121 antibody. Additionally, we identified amino acid residue combinations the substitution of which promoted an increase in desirable biophysical characteristics, while not impacting neutralization characteristics (e.g., neutralization or inactivation of viruses). Together, the interface residues and other residues were used to produce a library of variants (e.g., one or more of the Round-2 variants of Table 2) encompassing combinatorial residue replacements. The variants can be produced by transient expression (e.g., transient expression in Human Embryonic Kidney 293 (HEK293) or Chinese Hamster Ovary (CHO) cells) and the purified combinatorial variants can be analyzed for retention of neutralization activity (e.g., neutralization activity against pseudoviruses of human immunodeficiency virus (HIV), such as RHPA4259.7, Du172.17, CNE52, 0260.v5.c36, SC05.8C11.2344, Ce1176_A3, SC422661.8, BB1012-11.TC21, 263-8, X1193_c1, AC10.0.29, and 6952.v1.c20) and for desired biophysical characteristics (e.g., low-pH stability, solubility, thermal stability, chemical unfolding, and reduced aggregation). From this combinatorial library a subset of variants may be used to construct a library. The variants in the library were also tested to determine whether the heavy chain Fab glycan can be removed without impacting neutralization activity. Together, the combinatorial libraries of variants allow for identification of antibody variants or fragments thereof with desired biophysical characteristics, such as with significantly increased low pH stability (e.g., stability at pH less than 5.0, pH less than 4.6, pH less than 4.3, pH less than 4.0, pH less than 3.6, or at pH 3.5, pH 3.4, or pH 3.3), increased thermal stability (e.g., tested during thermal ramping between about 20-95° C. (e.g., about 20° C., 25° C., 30° C., 35° C., 40° C., 45° C., 50° C., 55° C., 60° C., 65° C., 70° C., 75° C., 80° C., 85° C., 90° C., or 95° C.)), increased solubility (e.g., in a final PEG 10,000 concentration of 7.9%), reduced aggregation (e.g., reduced levels of aggregation following low-pH (e.g., pH less than 5.0, pH less than 4.6, pH less than 4.3, pH less than 4.0, pH less than 3.6, or pH 3.5, pH 3.4, or pH 3.3) incubation) as evaluated by monomer and/or oligomer content (e.g., monomer content more than about 60% (e.g., more than about 65%, 70%, 75%, 80%, 85%, 90%, 91%, 92%, 93%, 94%, 95%, 96%, 97%, 98%, or 99%), and/or oligomer content less than about 10% (e.g., less than about 9%, 8%, 7%, 6%, 5%, 4%, 3%, 2%, 1%, 0.5%, 0.4%, 0.3%, 0.2%, or 0.1%)), and increased intramolecular and thermodynamic stability, such as chemical stability, as determined by chemical unfolding (e.g., tested by guanidine hydrochloride (GuHCl) or urea concentrations, preferably by GuHCl concentrations).

TABLE 1

Round-1 variants.

| Molecule | Light Chain (LC)-CDR 1-3 Amino acid (aa) SEQ ID NO: Nucleotide (nt) SEQ ID NO: Heavy Chain (HC)-CDR 1-3 Amino acid (aa) SEQ ID NO: | Light Chain Variable Domain Amino acid (aa) SEQ ID NO: Nucleotide (nt) SEQ ID NO: | Heavy Chain Variable Domain Amino acid (aa) SEQ ID NO: Nucleotide (nt) SEQ ID NO: | IgG1 Light Chain Modification (Relative to SEQ ID NO: 1394) | IgG1 Heavy Chain Modification (Relative to SEQ ID NO: 1393) | Fc Domain Modification (Relative to SEQ ID NO: 1401) |
|---|---|---|---|---|---|---|
| Set PGT121 | Nucleotide (nt) SEQ ID NO: LC-CDR 1-3 aa: 1398, 1399, 1400 HC-CDR 1-3 aa: 1395, 1396, 1397 | aa: 1394 | aa: 1393 | No modification | No modification | No modification |
| MS-42 | LC-CDR 1-3 aa: 564, 566, 568, nt: 563, 565, 567 HC-CDR 1-3 | aa: 562 nt: 561 | aa: 570 nt: 569 | No modification | No modification | M87L; N93S |

TABLE 1-continued

Round-1 variants.

| Molecule | Light Chain (LC)-CDR 1-3 Amino acid (aa) SEQ ID NO: Nucleotide (nt) SEQ ID NO: Heavy Chain (HC)-CDR 1-3 Amino acid (aa) SEQ ID NO: | Light Chain Variable Domain Amino acid (aa) SEQ ID NO: Nucleotide (nt) SEQ ID NO: | Heavy Chain Variable Domain Amino acid (aa) SEQ ID NO: Nucleotide (nt) SEQ ID NO: | IgG1 Light Chain Modification (Relative to SEQ ID NO: 1394) | IgG1 Heavy Chain Modification (Relative to SEQ ID NO: 1393) | Fc Domain Modification (Relative to SEQ ID NO: 1401) |
|---|---|---|---|---|---|---|
| MS-22 | aa: 572, 574, 576 nt: 571, 573, 575 LC-CDR 1-3 aa: 20, 22, 24, nt: 19, 21, 23, HC-CDR 1-3 aa: 28, 30, 32 nt: 27, 29, 31 | aa: 18 nt: 17 | aa: 26 nt: 25 | LmdV:S1P[1] | No modification | M87L; N93S |
| MS-46 | LC-CDR 1-3 aa: 36, 38, 40, nt: 35, 37, 39, HC-CDR 1-3 aa: 44, 46, 48 nt: 43, 45, 47 | aa: 34 nt: 33 | aa: 42 nt: 41 | LmdV:D2S | No modification | M87L; N93S |
| MS-47 | LC-CDR 1-3 aa: 52, 54, 56, nt: 51, 53, 55, HC-CDR 1-3 aa: 60, 62, 64 nt: 59, 61, 63 | aa: 50 nt: 49 | aa: 58 nt: 57 | LmdV:E9Q | No modification | M87L; N93S |
| MS-48 | LC-CDR 1-3 aa: 68, 70, 72, nt: 67, 69, 71, HC-CDR 1-3 aa: 76, 78, 80 nt: 75, 77, 79 | aa: 66 nt: 65 | aa: 74 nt: 73 | LmdV:H30Q | No modification | M87L; N93S |
| MS-49 | LC-CDR 1-3 aa: 84, 86, 88, nt: 83, 85, 87 HC-CDR 1-3 aa: 92, 94, 96 nt: 91, 93, 95 | aa: 82 nt: 81 | aa: 90 nt: 89 | LmdV:S37V | No modification | M87L; N93S |
| MS-50 | LC-CDR 1-3 aa: 100, 102, 104, nt: 99, 101, 103, HC-CDR 1-3 aa: 108, 110, 112 nt: 107, 109, 111 | aa: 98 nt: 97 | aa: 106 nt: 105 | LmdV:P58S | No modification | M87L; N93S |
| MS-51 | LC-CDR 1-3 aa: 116, 118, 120, nt: 115, 117, 119, HC-CDR 1-3 aa: 124, 126, 128 nt: 123, 125, 127 | aa: 114 nt: 113 | aa: 122 nt: 121 | LmdV:P61G | No modification | M87L; N93S |
| MS-52 | LC-CDR 1-3 aa: 132, 134, 136, nt: 131, 133, 135, HC-CDR 1-3 aa: 140, 142, 144 nt: 139, 141, 143 | aa: 130 nt: 129 | aa: 138 nt: 137 | LmdV:S72G | No modification | M87L; N93S |
| MS-53 | LC-CDR 1-3 aa: 148, 150, 152, nt: 147, 149, 151, HC-CDR 1-3 aa: 156, 158, 160 nt: 155, 157, 159 | aa: 146 nt: 145 | aa: 154 nt: 153 | LmdV:D87E | No modification | M87L; N93S |
| MS-54 | LC-CDR 1-3 aa: 164, 166, 168, nt: 163, 165, 167, HC-CDR 1-3 aa: 172, 174, 176 nt: 171, 173, 175 | aa: 162 nt: 161 | aa: 170 nt: 169 | LmdV:T101K | No modification | M87L; N93S |
| MS-55 | LC-CDR 1-3 aa: 180, 182, 184, nt: 179, 181, 183, HC-CDR 1-3 aa: 188, 190, 192 nt: 187, 189, 191 | aa: 178 nt: 177 | aa: 186 nt: 185 | No modification | HV:A27G | M87L; N93S |
| MS-56 | LC-CDR 1-3 aa: 196, 198, 200, nt: 195, 197, 199, | aa: 194 nt: 193 | aa: 202 nt: 201 | No modification | HV:D31E | M87L; N93S |

TABLE 1-continued

Round-1 variants.

| Molecule | Light Chain (LC)-CDR 1-3 Amino acid (aa) SEQ ID NO: Nucleotide (nt) SEQ ID NO: Heavy Chain (HC)-CDR 1-3 Amino acid (aa) SEQ ID NO: | Light Chain Variable Domain Amino acid (aa) SEQ ID NO: Nucleotide (nt) SEQ ID NO: | Heavy Chain Variable Domain Amino acid (aa) SEQ ID NO: Nucleotide (nt) SEQ ID NO: | IgG1 Light Chain Modification (Relative to SEQ ID NO: 1394) | IgG1 Heavy Chain Modification (Relative to SEQ ID NO: 1393) | Fc Domain Modification (Relative to SEQ ID NO: 1401) |
|---|---|---|---|---|---|---|
|  | HC-CDR 1-3 aa: 204, 206, 208 nt: 203, 205, 207 |  |  |  |  |  |
| MS-57 | LC-CDR 1-3 aa: 212, 214, 216, nt: 211, 213, 215, HC-CDR 1-3 aa: 220, 222, 224 nt: 219, 221, 223 | aa: 210 nt: 209 | aa: 218 nt: 217 | No modification | HV:D31S | M87L; N93S |
| MS-23 | LC-CDR 1-3 aa: 228, 230, 232, nt: 227, 229, 231 HC-CDR 1-3 aa: 236, 238, 240 nt: 235, 237, 239 | aa: 226 nt: 225 | aa: 234 nt: 233 | No modification | HV:R39Q | M87L; N93S |
| MS-24 | LC-CDR 1-3 aa: 244, 246, 248, nt: 243, 245, 247, HC-CDR 1-3 aa: 252, 254, 256 nt: 251, 253, 255 | aa: 242 nt: 241 | aa: 250 nt: 249 | No modification | HV:S40P | M87L; N93S |
| MS-25 | LC-CDR 1-3 aa: 260, 262, 264, nt: 259, 261, 263, HC-CDR 1-3 aa: 268, 270, 272 nt: 267, 269, 271 | aa: 258 nt: 257 | aa: 266 nt: 265 | No modification | HV:D56E | M87L; N93S |
| MS-44 | LC-CDR 1-3 aa: 276, 278, 280, nt: 275, 277, 279, HC-CDR 1-3 aa: 284, 286, 288 nt: 283, 285, 287 | aa: 274 nt: 273 | aa: 282 nt: 281 | No modification | HV:D56S | M87L; N93S |
| MS-26 | LC-CDR 1-3 aa: 292, 294, 296, nt: 291, 293, 295 HC-CDR 1-3 aa: 300, 302, 304 nt: 299, 301, 303 | aa: 290 nt: 289 | aa: 298 nt: 297 | No modification | HV:N68T | M87L; N93S |
| MS-27 | LC-CDR 1-3 aa: 308, 310, 312 nt: 307, 309, 311 HC-CDR 1-3 aa: 316, 318, 320 nt: 315, 317, 319 | aa: 306 nt: 305 | aa: 314 nt: 313 | No modification | HV:V78F | M87L; N93S |
| MS-28 | LC-CDR 1-3 aa: 324, 326, 328, nt: 323, 325, 327, HC-CDR 1-3 aa: 332, 334, 336 nt: 331, 333, 335 | aa: 322 nt: 321 | aa: 330 nt: 329 | No modification | HV:S81K | M87L; N93S |
| MS-29 | LC-CDR 1-3 aa: 340, 342, 344 nt: 339, 341, 343 HC-CDR 1-3 aa: 348, 350, 352 nt: 347, 349, 351 | aa: 338 nt: 337 | aa: 346 nt: 345 | No modification | HV:V83S | M87L; N93S |
| MS-30 | LC-CDR 1-3 aa: 356, 358, 360 nt: 355, 357, 359 HC-CDR 1-3 aa: 364, 366, 368 nt: 363, 365, 367 | aa: 354 nt: 353 | aa: 362 nt: 361 | No modification | HV:A84S | M87L; N93S |
| MS-31 | LC-CDR 1-3 aa: 372, 374, 376, nt: 371, 373, 375 HC-CDR 1-3 aa: 380, 382, 384 nt: 379, 381, 383 | aa: 370 nt: 369 | aa: 378 nt: 377 | No modification | HV:K92V | M87L; N93S |
| MS-32 | LC-CDR 1-3 aa: 388, 390, 392 | aa: 386 nt: 385 | aa: 394 nt: 393 | No modification | HV:N124Q | M87L; N93S |

TABLE 1-continued

Round-1 variants.

| Molecule | Light Chain (LC)-CDR 1-3 Amino acid (aa) SEQ ID NO: Nucleotide (nt) SEQ ID NO: Heavy Chain (HC)-CDR 1-3 Amino acid (aa) SEQ ID NO: | Light Chain Variable Domain Amino acid (aa) SEQ ID NO: Nucleotide (nt) SEQ ID NO: | Heavy Chain Variable Domain Amino acid (aa) SEQ ID NO: Nucleotide (nt) SEQ ID NO: | IgG1 Light Chain Modification (Relative to SEQ ID NO: 1394) | IgG1 Heavy Chain Modification (Relative to SEQ ID NO: 1393) | Fc Domain Modification (Relative to SEQ ID NO: 1401) |
|---|---|---|---|---|---|---|
| MS-36 | LC-CDR 1-3 aa: 468, 470, 472 nt: 467, 469, 471 HC-CDR 1-3 aa: 476, 478, 480 nt: 475, 477, 479 | aa: 466 nt: 465 | aa: 474 nt: 473 | LmdV:H30Q | HV:R39Q | M87L; N93S |
| MS-37 | LC-CDR 1-3 aa: 484, 486, 488, nt: 483, 485, 487 HC-CDR 1-3 aa: 492, 494, 496 nt: 491, 493, 495 | aa: 482 nt: 481 | aa: 490 nt: 489 | No modification | HV:R39Q; HV:S40P HV:K92V | M87L; N93S |
| MS-40 | LC-CDR 1-3 aa: 532, 534, 536 nt: 531, 533, 535 HC-CDR 1-3 aa: 540, 542, 544 nt: 539, 541, 543 | aa: 530 nt: 529 | aa: 538 nt: 537 | LmdV:E9Q; LmdV:H30Q; HV:K92V | No modification | M87L; N93S |

[1] The residue numbering for the heavy and light mutation(s) corresponds to the amino acid position of the mature linear sequence for the IgG1 heavy and light chain variable domains of the antibodies described in this table, which excludes the signal peptide sequence (amino acids 1-19) that are present in each of the SEQ ID NOs: of the IgG1 heavy and light domains for the specific PGT121 variant antibodies. For example, position 1 of the mature linear sequence of the light chain variable domain of MS-22 begins at amino acid position 20 of SEQ ID NO: 18. Position 20 of SEQ ID NO: 18 corresponds to the S1P substitution.

TABLE 2

Round-2 variants.

| Molecule Set | Light Chain (LC)-CDR 1-3 Amino acid (aa) SEQ ID NO: Nucleotide (nt) SEQ ID NO: Heavy Chain (HC)-CDR 1-3 Amino acid (aa) SEQ ID NO: Nucleotide (nt) SEQ ID NO: | Light Chain Variable Domain Amino acid (aa) SEQ ID NO: Nucleotide (nt) SEQ ID NO: | Heavy Chain Variable Domain Amino acid (aa) SEQ ID NO: Nucleotide (nt) SEQ ID NO: | IgG1 Light Chain Modification (Relative to SEQ ID NO: 1394) | IgG1 Heavy Chain Modification (Relative to SEQ ID NO: 1393) | Fc Domain Modification (Relative to SEQ ID NO: 1401) |
|---|---|---|---|---|---|---|
| MS-399 | LC-CDR 1-3 aa: 996, 998, 1000 nt: 995, 997, 999 HC-CDR 1-3 aa: 1004, 1006, 1008 nt: 1003, 1005, 1007 | aa: 994 nt: 993 | aa: 1002 nt: 1001 | LmdV:E9Q[2] LmdV:H30Q | HV:R39Q | M87L; N93S |
| MS-400 | LC-CDR 1-3 aa: 1012, 1014, 1016 nt: 1011, 1013, 1015 HC-CDR 1-3 aa: 1020, 1022, 1024 nt: 1019, 1021, 1023 | aa: 1010 nt: 1009 | aa: 1018 nt: 1017 | LmdV:H30Q LmdV:P61G | HV:R39Q | M87L; N93S |
| MS-401 | LC-CDR 1-3 aa: 1028, 1030, 1032 nt: 1027, 1029, 1031 HC-CDR 1-3 aa: 1036, 1038, 1040 nt: 1035, 1037, 1039 | aa: 1026 nt: 1025 | aa: 1034 nt: 1033 | LmdV:H30Q LmdV:T101K | HV:R39Q | M87L; N93S |
| MS-402 | LC-CDR 1-3 aa: 1044, 1046, 1048 nt: 1043, 1045, 1047 HC-CDR 1-3 aa: 1052, 1054, 1056 nt: 1051, 1053, 1055 | aa: 1042 nt: 1041 | aa: 1050 nt: 1049 | LmdV:H30Q | HV:R39Q HV:S40P | M87L; N93S |
| MS-403 | LC-CDR 1-3 aa: 1060, 1062, 1064 nt: 1059, 1061, 1063 HC-CDR 1-3 aa: 1068, 1070, 1072 nt: 1067, 1069, 1071 | aa: 1058 nt: 1057 | aa: 1066 nt: 1065 | LmdV:H30Q | HV:R39Q HV:V83S | M87L; N93S |

TABLE 2-continued

Round-2 variants.

| Molecule Set | Light Chain (LC)-CDR 1-3 Amino acid (aa) SEQ ID NO: Nucleotide (nt) SEQ ID NO: Heavy Chain (HC)-CDR 1-3 Amino acid (aa) SEQ ID NO: Nucleotide (nt) SEQ ID NO: | Light Chain Variable Domain Amino acid (aa) SEQ ID NO: Nucleotide (nt) SEQ ID NO: | Heavy Chain Variable Domain Amino acid (aa) SEQ ID NO: Nucleotide (nt) SEQ ID NO: | IgG1 Light Chain Modification (Relative to SEQ ID NO: 1394) | IgG1 Heavy Chain Modification (Relative to SEQ ID NO: 1393) | Fc Domain Modification (Relative to SEQ ID NO: 1401) |
|---|---|---|---|---|---|---|
| MS-404 | LC-CDR 1-3<br>aa: 1076, 1078, 1080<br>nt: 1075, 1077, 1079<br>HC-CDR 1-3<br>aa: 1084, 1086, 1088<br>nt: 1083, 1085, 1087 | aa: 1074<br>nt: 1073 | aa: 1082<br>nt: 1081 | LmdV:H30Q | HV:R39Q<br>HV:K92V | M87L; N93S |
| MS-405 | LC-CDR 1-3<br>aa: 1092, 1094, 1096<br>nt: 1091, 1093, 1095<br>HC-CDR 1-3<br>aa: 1100, 1102, 1104<br>nt: 1099, 1101, 1103 | aa: 1090<br>nt: 1089 | aa: 1098<br>nt: 1097 | LmdV:E9Q<br>LmdV:H30Q | HV:R39Q<br>HV:S40P | M87L; N93S |
| MS-406 | LC-CDR 1-3<br>aa: 1108, 1110, 1112<br>nt: 1107, 1109, 1111<br>HC-CDR 1-3<br>aa: 1116, 1118, 1120<br>nt: 1115, 1117, 1119 | aa: 1106<br>nt: 1105 | aa: 1114<br>nt: 1113 | LmdV:E9Q<br>LmdV:H30Q | HV:R39Q<br>HV:K92V | M87L; N93S |
| MS-407 | LC-CDR 1-3<br>aa: 1124, 1126, 1128<br>nt: 1123, 1125, 1127<br>HC-CDR 1-3<br>aa: 1132, 1134, 1136<br>nt: 1131, 1133, 1135 | aa: 1122<br>nt: 1121 | aa: 1130<br>nt: 1129 | LmdV:H30Q<br>LmdV:P61G<br>LmdV:T101K | HV:R39Q Fc-C:M87L | M87L; N93S |
| MS-408 | LC-CDR 1-3<br>aa: 1140, 1142, 1144<br>nt: 1139, 1141, 1143<br>HC-CDR 1-3<br>aa: 1148, 1150, 1152<br>nt: 1147, 1149, 1151 | aa: 1138<br>nt: 1137 | aa: 1146<br>nt: 1145 | LmdV:H30Q<br>LmdV:P61G | HV:R39Q<br>HV:V83S | M87L; N93S |
| MS-409 | LC-CDR 1-3<br>aa: 1156, 1158, 1160<br>nt: 1155, 1157, 1159<br>HC-CDR 1-3<br>aa: 1164, 1166, 1168<br>nt: 1163, 1165, 1167 | aa: 1154<br>nt: 1153 | aa: 1162<br>nt: 1161 | LmdV:H30Q<br>LmdV:T101K | HV:R39Q<br>HV:V83S | M87L; N93S |
| MS-410 | LC-CDR 1-3<br>aa: 1172, 1174, 1176<br>nt: 1171, 1173, 1175<br>HC-CDR 1-3<br>aa: 1180, 1182, 1184<br>nt: 1179, 1181, 1183 | aa: 1170<br>nt: 1169 | aa: 1178<br>nt: 1177 | LmdV:H30Q | HV:R39Q<br>HV:S40P<br>HV:K92V | M87L; N93S |
| MS-411 | LC-CDR 1-3<br>aa: 1188, 1190, 1192<br>nt: 1187, 1189, 1191<br>HC-CDR 1-3<br>aa: 1196, 1198, 1200<br>nt: 1195, 1197, 1199 | aa: 1186<br>nt: 1185 | aa: 1194<br>nt: 1193 | LmdV:E9Q<br>LmdV:H30Q | HV:R39Q<br>HV:S40P<br>HV:K92V | M87L; N93S |
| MS-412 | LC-CDR 1-3<br>aa: 1204, 1206, 1208<br>nt: 1203, 1205, 1207<br>HC-CDR 1-3<br>aa: 1212, 1214, 1216<br>nt: 1211, 1213, 1215 | aa: 1202<br>nt: 1201 | aa: 1210<br>nt: 1209 | LmdV:H30Q<br>LmdV:P61G<br>LmdV:T101K | HV:R39Q<br>HV:V83S | M87L; N93S |
| MS-413 | LC-CDR 1-3<br>aa: 1220, 1222, 1224<br>nt: 1219, 1221, 1223<br>HC-CDR 1-3<br>aa: 1228, 1230, 1232<br>nt: 1227, 1229, 1231 | aa: 1218<br>nt: 1217 | aa: 1226<br>nt: 1225 | LmdV:E9Q<br>LmdV:H30Q<br>LmdV:P61G | HV:R39Q<br>HV:V83S<br>HV:K92V | M87L; N93S |
| MS-414 | LC-CDR 1-3<br>aa: 1236, 1238, 1240<br>nt: 1235, 1237, 1239<br>HC-CDR 1-3<br>aa: 1244, 1246, 1248<br>nt: 1243, 1245, 1247 | aa: 1234<br>nt: 1233 | aa: 1242<br>nt: 1241 | LmdV:H30Q<br>LmdV:P61G | HV:R39Q<br>HV:S40P<br>HV:V83S<br>HV:K92V | M87L; N93S |
| MS-437 | LC-CDR 1-3<br>aa: 1252, 1254, 1256<br>nt: 1251, 1253, 1255<br>HC-CDR 1-3 | aa: 1250<br>nt: 1249 | aa: 1258<br>nt: 1257 | LmdV:H30Q<br>LmdV:P61G | HV:R39Q<br>HV:N124Q | M87L; N93S |

TABLE 2-continued

Round-2 variants.

| Molecule Set | Light Chain (LC)-CDR 1-3 Amino acid (aa) SEQ ID NO: Nucleotide (nt) SEQ ID NO: Heavy Chain (HC)-CDR 1-3 Amino acid (aa) SEQ ID NO: Nucleotide (nt) SEQ ID NO: | Light Chain Variable Domain Amino acid (aa) SEQ ID NO: Nucleotide (nt) SEQ ID NO: | Heavy Chain Variable Domain Amino acid (aa) SEQ ID NO: Nucleotide (nt) SEQ ID NO: | IgG1 Light Chain Modification (Relative to SEQ ID NO: 1394) | IgG1 Heavy Chain Modification (Relative to SEQ ID NO: 1393) | Fc Domain Modification (Relative to SEQ ID NO: 1401) |
|---|---|---|---|---|---|---|
| MS-438 | aa: 1260, 1262, 1264 nt: 1259, 1261, 1263 LC-CDR 1-3 aa: 1268, 1270, 1272, nt: 1267, 1269, 1271 HC-CDR 1-3 aa: 1276, 1278, 1280 nt: 1275, 1277, 1279 | aa: 1266 nt: 1265 | aa: 1274 nt: 1273 | LmdV:H30Q | HV:R39Q HV:V83S HV:N124Q | M87L; N93S |
| MS-439 | LC-CDR 1-3 aa: 1284, 1286, 1288 nt: 1283, 1285, 1287 HC-CDR 1-3 aa: 1292, 1294, 1296 nt: 1291, 1293, 1295 | aa: 1282 nt: 1281 | aa: 1290 nt: 1289 | LmdV:H30Q LmdV:T101K | HV:R39Q HV:N124Q | M87L; N93S |
| MS-440 | LC-CDR 1-3 aa: 1300, 1302, 1304 nt: 1299, 1301, 1303 HC-CDR 1-3 aa: 1308, 1310, 1312 nt: 1307, 1309, 1311 | aa: 1298 nt: 1297 | aa: 1306 nt: 1305 | LmdV:H30Q LmdV:T101K | HV:R39Q HV:V83S HV:N124Q | M87L; N93S |
| MS-441 | LC-CDR 1-3 aa: 1316, 1318, 1320 nt: 1315, 1317, 1319 HC-CDR 1-3 aa: 1324, 1326, 1328 nt: 1323, 1325, 1327 | aa: 1314 nt: 1313 | aa: 1322 nt: 1321 | LmdV:H30Q LmdV:P61G LmdV:T101K | HV:R39Q HV:N124Q | M87L; N93S |
| MS-442 | LC-CDR 1-3 aa: 1332, 1334, 1336 nt: 1331, 1333, 1335 HC-CDR 1-3 aa: 1340, 1342, 1344 nt: 1339, 1341, 1343 | aa: 1330 nt: 1329 | aa: 1338 nt: 1337 | LmdV:H30Q LmdV:P61G | HV:R39Q HV:V83S HV:N124Q | M87L; N93S |
| MS-443 | LC-CDR 1-3 aa: 1348, 1350, 1352 nt: 1347, 1349, 1351 HC-CDR 1-3 aa: 1356, 1358, 1360 nt: 1355, 1357, 1359 | aa: 1346 nt: 1345 | aa: 1354 nt: 1353 | LmdV:H30Q LmdV:P61G LmdV:T101K | HV:R39Q HV:V83S HV:N124Q | M87L; N93S |
| MS-444 | LC-CDR 1-3 aa: 1364, 1366, 1368 nt: 1363, 1365, 1367 HC-CDR 1-3 aa: 1372, 1374, 1376 nt: 1371, 1373, 1375 | aa: 1362 nt: 1361 | aa: 1370 nt: 1369 | LmdV:H30Q LmdV:P61G | HV:R39Q HV:S40P HV:V83S HV:K92V HV:N124Q | M87L; N93S |
| MS-445 | LC-CDR 1-3 aa: 1380, 1382, 1384 nt: 1379, 1381, 1383 HC-CDR 1-3 aa: 1388, 1390, 1392 nt: 1387, 1389, 1391 | aa: 1378 nt: 1377 | aa: 1386 nt: 1385 | LmdV:E9Q LmdV:H30Q LmdV:P61G | HV:R39Q HV:V83S HV:K92V HV:N124Q | M87L; N93S |

[2] The residue numbering for the heavy and light mutation(s) corresponds to the amino acid position of the mature linear sequence for the IgG1 heavy and light chain variable domains of the antibodies described in this table, which excludes the signal peptide sequence (amino acids 1-19) that are present in each of the SEQ ID NOs: of the IgG1 heavy and light chain domains for the specific PGT121 variant antibodies. For example, position 1 of the mature linear sequence of the light chain variable domain of MS-399 begins at amino acid position 20 of SEQ ID NO: 994. Thus, the E9Q substitution of MS-399 corresponds to amino acid position 28 of SEQ ID NO: 994.

III. Biophysical Properties of the PGT121 Antibody Variants

PGT121 variant antibodies and antigen-binding fragments thereof that are produced by the optimization program described herein exhibit one or more of the following biophysical characteristics: increased low-pH stability; increased thermal stability; increased solubility; reduced aggregation; and increased intramolecular and thermodynamic stability, such as chemical stability, as determined by chemical unfolding. These biophysical attributes have been shown to be linked to improved manufacturability and storage stability.

Solubility

The PGT121 variant antibodies or fragments thereof described herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445, and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) exhibit improved solubility, e.g., relative to the native PGT121 antibody. The featured PGT121 variant antibodies or fragments thereof described herein exhibit solubility of at least 1 mg/ml (e.g., 0.1 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, 1 mg/ml, 1.5 mg/ml, 2.0 mg/ml, 2.5 mg/ml, 3.0 mg/ml, 3.5 mg/ml, 4.0 mg/ml, 4.5 mg/ml, 5.0 mg/ml, 5.5 mg/ml, 6.0 mg/ml, 6.5 mg/ml, 7.0 mg/ml, 7.5 mg/ml, 8.0 mg/ml, 8.5 mg/ml, 9.0 mg/ml, 9.5 mg/ml, or 10.0 mg/ml) in a solution containing 6-9% PEG 10,000 (e.g., 6.1%, 6.2%, 6.3%, 6.4%, 6.5%, 6.6%, 6.7%, 6.8%, 6.9%, 7.0%, 7.1%, 7.2%, 7.3%, 7.4%, 7.5%, 7.6%, 7.7%, 7.8%, 7.9%, 8.0%, 8.1%, 8.2%, 8.3%, 8.4%, 8.5%, 8.6%, 8.7%, 8.8%, 8.9%, or 9% PEG 10,000). In particular, at least 1 mg/ml of the antibody or fragment thereof is soluble in a solution with a concentration of 7.9% PEG 10,000. Improved solubility of the PGT121 variant antibodies and fragments thereof, relative to the native PGT121 antibody, increases efficient production (e.g., higher production titer) of the antibodies by minimizing the amounts of antibodies lost through precipitation (e.g., aggregation).

Thermal Stability

The PGT121 variant antibodies or fragments thereof described herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) exhibit high thermal stability, e.g., relative to the native PGT121 antibody. The PGT121 variant antibodies and fragments thereof described herein exhibit reduced degradation or resistance to degradation upon exposure to a wide range of temperature variations (e.g., thermal ramping at temperatures of between about 20-95° C. (e.g., about 20° C., 25° C., 30° C., 35° C., 40° C., 45° C., 50° C., 55° C., 60° C., 65° C., 70° C., 75° C., 80° C., 85° C., 90° C., or 95° C.)). Thermal stability of the PGT121 variant antibodies or fragments thereof described herein ensure their stability and sustainability when exposed to extreme non-physiologic conditions, such as conditions during manufacture or production of the antibodies. The improved thermal stability of the PGT121 variant antibodies or fragments thereof described herein contributes to their improved manufacturability. Improved thermal stability of the PGT121 variant antibodies or fragments thereof described herein also contributes to improved storage stability (e.g., stability when stored at a temperature of about −40° C. to 50° C. (e.g., about −40° C., −35° C., −30° C., −25° C., −20° C., −15° C., −10° C., −5° C., 0° C., 5° C., 10° C., 15° C., 20° C., 25° C., 30° C., 35° C., 40° C., 45° C., or 50° C.) over 2 days, 3 days, 4 days, 5 days, 6 days, 1 week, 2 weeks, 3 weeks, 1 month, 2 months, 3 months, 4 months, 5 months, 6 months, 1 year, 2 years, 3 years, 4 years, 5 years, or more), making them more suitable for extended storage and subsequent therapeutic application. Thermal stability of the PGT121 variant antibodies or fragments thereof during manufacture or storage (e.g., stability when stored at a temperature of about −40° C. to 50° C. (e.g., about −40° C., −35°, −30° C., −25°, −20° C., −15° C., −10° C., −5° C., 0° C., 5° C., 10° C., 15° C., 20° C., 25° C., 30° C., 35° C., 40° C., 45° C., or 50° C.) over 2 days, 3 days, 4 days, 5 days, 6 days, 1 week, 2 weeks, 3 weeks, 1 month, 2 months, 3 months, 4 months, 5 months, 6 months, 1 year, 2 years, 3 years, 4 years, 5 years, or more) can be measured in terms of reduced aggregation or resistance to aggregation (e.g., a percent oligomer increase of less than about 5%, less than about 4%, less than about 3%, less than about 2%, less than about 1%, less than about 0.9%, less than about 0.8%, less than about 0.7%, less than about 0.6%, less than about 0.5%, less than about 0.4%, less than about 0.3%, less than about 0.2%, less than about 0.1%, less than about 0.09%, less than about 0.08%, less than about 0.07%, less than about 0.06%, less than about 0.05%, less than about 0.04%, less than about 0.03%, less than about 0.02%, or less than about 0.01%), as evaluated by monomer and/or oligomer content (e.g., monomer content more than about 60% (e.g., more than about 65%, 70%, 75%, 80%, 85%, 90%, 91%, 92%, 93%, 94%, 95%, 96%, 97%, 98%, or 99%), and/or oligomer content less than about 10% (e.g., less than about 9%, 8%, 7%, 6%, 5%, 4%, 3%, 2%, 1%, 0.5%, 0.4%, 0.3%, 0.2%, or 0.1%)).

Chemical Stability

The PGT121 variant antibodies or fragments thereof described herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) exhibit increased chemical stability, e.g., relative to the native PGT121 antibody. The featured PGT121 variant antibodies and fragments thereof exhibit chemical stability, as determined by chemical unfolding (e.g., as tested by guanidine hydrochloride (GuHCl) or urea concentrations, preferably by GuHCl concentrations). For example, the PGT121 variant antibodies described herein exhibit increased chemical stability at a final concentration of the antibody or fragment thereof of 0.01-5.0 mg/ml (e.g., 0.02 mg/ml, 0.03 mg/ml, 0.04 mg/ml, 0.05 mg/ml, 0.06 mg/ml, 0.07 mg/ml, 0.08 mg/ml, 0.09 mg/ml, 1.0 mg/ml, 1.5 mg/ml, 2.0 mg/ml, 2.5 mg/ml, 3.0 mg/ml, 3.5 mg/ml, 4.0 mg/ml, 4.5 mg/ml, or 5.0 mg/ml, for example at a final concentration is 0.05 mg/ml) in the presence of GuHCl (e.g., a concentration of GuHCL of greater than 0.001 M to 6 M GuHCL), relative to the native PGT121 antibody. In specific embodiments, the PGT121 variant antibody or fragment thereof (e.g., at a concentration of 0.05 mg/ml) is resistant to chemical unfolding in the presence of 3.0 M or greater GuHCL (e.g., greater than 3.5 M, greater than 4.0 M, greater than 4.5 M, greater than 5.0 M, or greater than 5.5 M) GuHCl. In preferred embodiments, the PGT121 variant antibody or fragment thereof is resistant to chemical unfolding in the presence of 6.0 M GuHCl. The improved chemical stability of the PGT121 variant antibodies or fragments thereof described herein indicates that the PGT121 variant antibodies and fragments thereof exhibit improved stability and sustainability under various conditions, such as those during manufacture or production of the antibodies or fragments thereof. The chemical stability of the PGT121 variant antibodies or fragments thereof described herein thus contributes to the improved manufacturability of the same.

Low-pH Stability

The PGT121 variant antibodies or fragments thereof described herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) exhibit improved stability at low pH, e.g., relative to the native PGT121 antibody. The featured PGT121 variant antibodies and fragments thereof exhibit improved stability (e.g., reduced aggregation) when exposed to low pH, such as a pH of less than pH 5.0 (e.g., less than pH 4.6, less than pH 4.3, less than pH 4.0, less than pH 3.6, less than pH 3.5, less than pH 3.4, less than pH 3.3, less than pH 3.2, less than pH 3.1, or less than pH 3.0), or equal to pH 4.5, pH 4.0, pH 3.5, pH 3.4, pH 3.3, pH 3.2, pH 3.1, pH 3.0, or pH 2.5. In preferred embodiments the featured PGT121 variant antibodies or fragments thereof exhibit improved stability at pH 3.5, pH 3.4, or pH 3.3, e.g., relative to the native PGT121 antibody. The stability of the PGT121 variant antibodies or fragments thereof at low pH is measured in terms of reduced aggregation or resistance to aggregation upon exposure to the low pH conditions. The featured PGT121 variant antibodies or fragments thereof do not aggregate or exhibit reduced aggregation (e.g., reduced high molecular weight species formation (e.g., a percent oligomer increase of less than about 5%, less than about 4%, less than about 3%, less than about 2%, less than about 1%, less than about 0.9%, less than about 0.8%, less than about 0.7%, less than about 0.6%, less than about 0.5%, less than about 0.4%, less than about 0.3%, less than about 0.2%, less than about 0.1%, less than about 0.09%, less than about 0.08%, less than about 0.07%, less than about 0.06%, less than about 0.05%, less than about 0.04%, less than about 0.03%, less than about 0.02%, or less than about 0.01%)), as evaluated by monomer and/or oligomer content (e.g., monomer content more than about 60% (e.g., more than about 65%, 70%, 75%, 80%, 85%, 90%, 91%, 92%, 93%, 94%, 95%, 96%, 97%, 98%, or 99%), and/or oligomer content less than about 10% (e.g., less than about 9%, 8%, 7%, 6%, 5%, 4%, 3%, 2%, 1%, 0.5%, 0.4%, 0.3%, 0.2%, or 0.1%)) at low pH, which in preferred embodiments is pH 3.5, pH 3.4, or pH 3.3. The improved low-pH stability of the PGT121 variant antibodies or fragments thereof described herein ensures their stability and sustainability when exposed to low pH or acidic conditions, e.g., during manufacture or production of the antibodies and fragments thereof. Low-pH stability of the PGT121 variant antibodies or fragments thereof described herein thus contributes to the improved manufacturability of the same.

Reduced Aggregation

The PGT121 variant antibodies or fragments thereof described herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) exhibit reduced aggregation (e.g., reduced aggregation when exposed to low pH, solubilizing or chaotropic chemicals, and/or increased temperatures), e.g., relative to the native PGT121 antibody. Aggregation can be evaluated by monitoring monomer content and/or oligomer content over time (e.g., over days, weeks, months, or years). The featured PGT121 variant antibodies and fragments thereof exhibit reduced aggregation (e.g., reduced levels of aggregation (e.g., a percent oligomer increase of less than about 5%, less than about 4%, less than about 3%, less than about 2%, less than about 1%, less than about 0.9%, less than about 0.8%, less than about 0.7%, less than about 0.6%, less than about 0.5%, less than about 0.4%, less than about 0.3%, less than about 0.2%, less than about 0.1%, less than about 0.09%, less than about 0.08%, less than about 0.07%, less than about 0.06%, less than about 0.05%, less than about 0.04%, less than about 0.03%, less than about 0.02%, or less than about 0.01%) following low-pH (e.g., pH 3.5, pH 3.4, pH 3.3, etc.) incubation), as evaluated by monomer and/or oligomer content (e.g., monomer content more than about 60% (e.g., more than about 65%, 70%, 75%, 80%, 85%, 90%, 91%, 92%, 93%, 94%, 95%, 96%, 97%, 98%, or 99%), and/or oligomer content less than about 10% (e.g., less than about 9%, 8%, 7%, 6%, 5%, 4%, 3%, 2%, 1%, 0.5%, 0.4%, 0.3%, 0.2%, or 0.1%)). Reduced aggregation (e.g., a percent oligomer increase of less than about 5%, less than about 4%, less than about 3%, less than about 2%, less than about 1%, less than about 0.9%, less than about 0.8%, less than about 0.7%, less than about 0.6%, less than about 0.5%, less than about 0.4%, less than about 0.3%, less than about 0.2%, less than about 0.1%, less than about 0.09%, less than about 0.08%, less than about 0.07%, less than about 0.06%, less than about 0.05%, less than about 0.04%, less than about 0.03%, less than about 0.02%, or less than about 0.01%) of the PGT121 variant antibodies or fragments thereof described herein ensure their stability and sustainability when exposed to chemicals, low pH conditions (e.g., pH 3.5, pH 3.4, pH 3.3, etc.), and extreme temperatures (e.g., large temperature variations or increased temperatures, e.g., in range of about −40° C. to 95° C. (e.g., about −40° C., −35° C., −30° C., −25° C., −20° C., −15° C., −10° C., −5° C., 0° C., 5° C., 10° C., 15° C., 20° C., 25° C., 30° C., 35° C., 40° C., 45° C., 50° C., 55° C., 60° C., 65° C., 70° C., 75° C., 80° C., 85° C., 90° C., or 95° C.)) during manufacture or production of the antibodies or fragments thereof. Reduced aggregation of the PGT121 variant antibodies or fragments thereof described herein thus contributes to improved manufacturability of the same. Reduced aggregation (e.g., a percent oligomer increase of less than about 5%, less than about 4%, less than about 3%, less than about 2%, less than about 1%, less than about 0.9%, less than about 0.8%, less than about 0.7%, less than about 0.6%, less than about 0.5%, less than about 0.4%, less than about 0.3%, less than about 0.2%, less than about 0.1%, less than about 0.09%, less than about 0.08%, less than about 0.07%, less than about 0.06%, less than about 0.05%, less than about 0.04%, less than about 0.03%, less than about 0.02%, or less than about 0.01%) of the PGT121 variant antibodies or fragments thereof described herein also ensures their stability during storage (e.g., storage for over 2 days, over 3 days, over 4 days, over 5 days, over 6 days, over 1 week, over 2 weeks, over 3 weeks, over 1 month, over 2 months, over 3 months, over 4 months, over 5 months, over 6 months, over 7 months, over 8 months, over 9 months, over 10 months, over 11 months, over 1 year, over 2 years, over 3 years, over 4 years, over 5 years, or more, at a temperature of about −40° C. to 50° C. (e.g., about −40° C., −35° C., −30° C., −25° C., −20° C., −15° C., −10° C., −5° C., 0° C., 5° C., 10° C., 15° C., 20° C., 25° C., 30° C., 35° C., 40° C., 45° C., or 50° C.)). Storage stability of the PGT121 variant antibodies or fragments thereof also ensures longer shelf life, retention of efficacy and safer therapeutic application of the same. With improved manufacturability and storage stability, the PGT121 variant antibodies or antigen-binding fragments thereof, featured herein, exhibit improved characteristics relative to the native PGT121 antibody.

Pharmacokinetics

The PGT121 antibody variant or antigen-binding fragments thereof described herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) may exhibit a half-life of at least about 1 hour (e.g., at least about 1 hour, 2 hour, 3 hour, 4 hour, 5 hour, 6 hour, 7 hour, 8 hour, 9 hour, 10 hour, 11 hour, 12 hour, 13 hour, 14 hour 15 hour, 16 hour, 17 hour, 18 hour, 19 hour, 20 hour, 21 hour, 22 hour, 23 hour, 1 day, 2 day, 3 day, 4 day, 5 day, 6 day, 7 day, 8 day, 9 day, 10 day, 11 day, 12 day, 13 day, 14 day, 15 day, 16 day, 17 day, 18 day, 19 day, 20 day, 21 day, 22 day, 23 day, 24 day, 25 day, 26 day, 27 day, 28 day, or more) in vitro or in vivo (e.g., following administration to a subject (e.g., a human)). For example, the PGT121 antibody variants or antigen-binding fragments thereof described herein may exhibit a half-life of at least about 1 hour (e.g., at least about 1 hour, 2 hour, 3 hour, 4 hour, 5 hour, 6 hour, 7 hour, 8 hour, 9 hour, 10 hour, 11 hour, 12 hour, 13 hour, 14 hour 15 hour, 16 hour, 17 hour, 18 hour, 19 hour, 20 hour, 21 hour, 22 hour, 23 hour, 1 day, 2 day, 3 day, 4 day, 5 day, 6 day, 7 day, 8 day, 9 day, 10 day, 11 day, 12 day, 13 day, 14 day, 15 day, 16 day, 17 day, 18 day, 19 day, 20 day, 21 day, 22 day, 23 day, 24 day, 25 day, 26 day, 27 day, 28 day, or more) in vivo (e.g., in a fluid, such as blood) following administration (e.g., intravenous administration) to a subject (e.g., a human).

IV. Production of the PGT121 Antibody Variants

The PGT121 antibody variant or antigen-binding fragment thereof described herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) may be in the form of a single-chain polypeptide, such as a scFv fragment. Single chain polypeptides may alternatively contain one or more CDRs described herein covalently bound to one another using conventional bond-forming techniques known in the art, for instance, by an amide bond, a thioether bond, a carbon-carbon bond, or by a linker, such as a peptide linker or a linker formed by nucleophilic substitution of a multivalent electrophile (e.g., a bis(bromomethyl) arene derivative, such as a bis(bromomethyl)benzene or bis(bromomethyl)pyridine) described herein or known in the art.

Single-chain polypeptides can be produced by a variety of recombinant and synthetic techniques, such as by recombinant gene expression or solid-phase peptide synthesis procedures described herein or known in the art. For instance, one of skill in the art can design polynucleotides encoding, e.g., two or more CDRs operably linked to one another in frame so as to produce a continuous, single-chain peptide containing these CDRs. Optionally, the CDRs may be separated by a spacer, such as by a framework region (e.g., a framework sequence described herein or a framework region of a germline consensus sequence of a human antibody) or a flexible linker, such as a poly-glycine or glycine/serine linker described herein or known in the art. When produced by chemical synthesis methods, native chemical ligation can optionally be used as a strategy for the synthesis of long peptides (e.g., greater than 50 amino acids). Native chemical ligation protocols are known in the art and have been described, e.g., by Dawson et al. (Science, 266:776-779, 1994); incorporated herein by reference. A detailed description of techniques for the production of single-chain polypeptides, full-length antibodies, and antibody fragments is provided in the sections that follow.

The PGT121 antibody variant or antigen-binding fragment thereof described herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) can be prepared by any of a variety of established techniques. For instance, an antibody or antigen-binding fragment thereof described herein can be prepared by recombinant expression of immunoglobulin light and heavy chain genes in a host cell. To express an antibody recombinantly, a host cell can be transfected with one or more recombinant expression vectors carrying DNA fragments encoding the immunoglobulin light and heavy chains of the antibody such that the light and heavy chains are expressed in the host cell and, optionally, secreted into the medium in which the host cells are cultured, from which medium the antibodies can be recovered. Standard recombinant DNA methodologies are used to obtain antibody heavy and light chain genes, incorporate these genes into recombinant expression vectors and introduce the vectors into host cells, such as those described in Molecular Cloning; A Laboratory Manual, Second Edition (Sambrook, Fritsch and Maniatis (eds), Cold Spring Harbor, N. Y., 1989), Current Protocols in Molecular Biology (Ausubel et al., eds., Greene Publishing Associates, 1989), and in U.S. Pat. No. 4,816,397; the disclosures of each of which are incorporated herein by reference. A method for recombinant expression of the PGT121 antibody variant MS-414 is described in Example 6. This method, or similar methods, can be used for expression of one or more of the other PGT121 antibody variants or fragments thereof described herein.

Expression Vectors

Viral genomes provide a rich source of vectors that can be used for the efficient delivery of exogenous genes into the genome of a cell (e.g., a eukaryotic or prokaryotic cell). Viral genomes are particularly useful vectors for gene delivery because the polynucleotides contained within such genomes are typically incorporated into the genome of a target cell by generalized or specialized transduction. These processes occur as part of the natural viral replication cycle, and do not require added proteins or reagents in order to induce gene integration. Examples of viral vectors include a retrovirus, adenovirus (e.g., Ad5, Ad26, Ad34, Ad35, and Ad48), parvovirus (e.g., adeno-associated viruses), coronavirus, negative strand RNA viruses such as orthomyxovirus (e.g., influenza virus), rhabdovirus (e.g., rabies and vesicular stomatitis virus), paramyxovirus (e.g. measles and Sendai), positive strand RNA viruses, such as picornavirus and alphavirus, and double stranded DNA viruses including adenovirus, herpesvirus (e.g., Herpes Simplex virus types 1 and 2, Epstein-Barr virus, cytomegalovirus), and poxvirus (e.g., vaccinia, modified vaccinia Ankara (MVA), fowlpox and canarypox). Other viruses useful for delivering polynucleotides encoding antibody light and heavy chains or antibody fragments described herein include Norwalk virus, togavirus, flavivirus, reoviruses, papovavirus, hepadnavirus, and hepatitis virus, for example. Examples of retroviruses include: avian leukosis-sarcoma, mammalian C-type, B-type viruses, D-type viruses, HTLV-BLV group, lentivirus, spumavirus (Coffin, J. M., Retroviridae: The viruses and their replication, In Fundamental Virology, Third Edition, B. N. Fields, et al., Eds., Lippincott-Raven Publishers, Philadelphia, 1996). Other examples include murine leukemia viruses, murine sarcoma viruses, mouse mammary tumor virus, bovine leukemia virus, feline leukemia virus, feline sarcoma virus, avian leukemia virus, human T cell leukemia virus, baboon endogenous virus, Gibbon ape leukemia virus, Mason Pfizer monkey virus, simian immunodeficiency virus, simian sarcoma virus, Rous sarcoma virus and lentiviruses. Other examples of vectors are described, for example, in McVey et al., (U.S. Pat. No. 5,801,030); the disclosures of each of which are incorporated herein by reference.

Genome Editing Techniques

In addition to viral vectors, a variety of additional methods have been developed for the incorporation of genes, e.g., those encoding antibody light and heavy chains, single-chain polypeptides, single-chain variable fragments (scFvs), tandem scFvs, Fab domains, F(ab')2 domains, diabodies, and triabodies, among others, into the genomes of target cells for polypeptide expression. One such method that can be used for incorporating polynucleotides encoding antibody variants, or antigen-binding fragments thereof (e.g., single-chain polypeptides, antibodies, antigen-binding fragments thereof, or constructs), into prokaryotic or eukaryotic cells includes transposons. Transposons are polynucleotides that encode transposase enzymes and contain a polynucleotide sequence or gene of interest flanked by excision sites at the 5' and 3' positions. Once a transposon has been delivered into a cell, expression of the transposase gene commences and results in active enzymes that cleave the gene of interest from the transposon. This activity is mediated by the site-specific recognition of transposon excision sites by the transposase. In some embodiments, these excision sites may be terminal repeats or inverted terminal repeats. Once excised from the transposon, the gene of interest can be integrated into the genome of a prokaryotic or eukaryotic cell by transposase-catalyzed cleavage of similar excision sites that exist within nuclear genome of the cell. This allows the gene encoding the antibody variant described in the invention or fragment or domain thereof to be inserted into the cleaved nuclear DNA at the excision sites, and subsequent ligation of the phosphodiester bonds that join the gene of interest to the DNA of the prokaryotic or eukaryotic cell genome completes the incorporation process. In some embodiments, the transposon may be a retrotransposon, such that the gene encoding the antibody is first transcribed to an RNA product and then reverse-transcribed to DNA before incorporation in the prokaryotic or eukaryotic cell genome. Exemplary transposon systems include the piggybac transposon (described in detail in WO 2010/085699) and the sleeping beauty transposon (described in detail in US20050112764); the disclosures of each of which are incorporated herein by reference.

Another useful method for the integration of nucleic acid molecules encoding the antibody or antigen-binding fragments thereof (e.g., single-chain polypeptides, antibodies, or antigen-binding fragments thereof) into the genome of a prokaryotic or eukaryotic cell is the clustered regularly interspaced short palindromic repeats (CRISPR)/Cas system, which is a system that originally evolved as an adaptive defense mechanism in bacteria and archaea against infection by viruses. The CRISPR/Cas system consists of palindromic repeat sequences within plasmid DNA and an associated Cas9 nuclease. This ensemble of DNA and protein directs site specific DNA cleavage of a target sequence by first incorporating foreign DNA into CRISPR loci. Polynucleotides containing these foreign sequences and the repeat-spacer elements of the CRISPR locus are in turn transcribed in a host cell to create a guide RNA, which can subsequently anneal to a target sequence and localize the Cas9 nuclease to this site. In this manner, highly site-specific cas9-mediated DNA cleavage can be engendered in a foreign polynucleotide because the interaction that brings cas9 within close proximity of the target DNA molecule is governed by RNA:DNA hybridization. As a result, one can theoretically design a CRISPR/Cas system to cleave any target DNA molecule of interest. This technique has been exploited in order to edit eukaryotic genomes (Hwang et al., Nat. Biotech., 31:227-229, 2013) and can be used as an efficient means of site-specifically editing eukaryotic or prokaryotic genomes in order to cleave DNA prior to the incorporation of a polynucleotide encoding an anti-TNFR2 polypeptides (e.g., single-chain polypeptides, antibodies, or antigen-binding fragments thereof) described herein. The use of CRISPR/Cas to modulate gene expression has been described in U.S. Pat. No. 8,697,359, the disclosure of which is incorporated herein by reference.

Alternative methods for site-specifically cleaving genomic DNA prior to the incorporation of a polynucleotide encoding an antibody or antibody fragment described herein include the use of zinc finger nucleases and transcription activator-like effector nucleases (TALENs). Unlike the CRISPR/Cas system, these enzymes do not contain a guiding polynucleotide to localize to a specific target sequence. Target specificity is instead controlled by DNA binding domains within these enzymes. Zinc finger nucleases and TALENs for use in genome editing applications are described in Urnov et al. (Nat. Rev. Genet., 11:636-646, 2010); and in Joung et al., (Nat. Rev. Mol. Cell. Bio. 14:49-55, 2013); incorporated herein by reference. Additional genome editing techniques that can be used to incorporate polynucleotides encoding antibodies described herein into the genome of a prokaryotic or eukaryotic cell include the use of ARCUS™ meganucleases that can be rationally designed so as to site-specifically cleave genomic DNA. The use of these enzymes for the incorporation of polynucleotides encoding antibodies (e.g., antibodies, antigen-binding fragments thereof, or constructs) described herein into the genome of a prokaryotic or eukaryotic cell is particularly advantageous in view of the structure-activity relationships that have been established for such enzymes. Single-chain meganucleases can thus be modified at certain amino acid positions in order to create nucleases that selectively cleave DNA at desired locations. These single-chain nucleases have been described extensively, e.g., in U.S. Pat. Nos. 8,021,867 and 8,445,251; the disclosures of each of which are incorporated herein by reference.

Polynucleotide Sequence Elements

To express antibodies (e.g., single-chain polypeptides, antibodies, antigen-binding fragments thereof, or constructs) described herein, polynucleotides encoding partial or full-length light and heavy chains, e.g., polynucleotides that encode one or more, or all, of the CDR sequences of a PGT121 antibody variant or antigen-binding fragment thereof described herein can be inserted into an expression vector such that the nucleic acid molecules encoding the PGT121 antibody variant sequences are operatively linked to transcriptional and translational control sequences. The expression vector and expression control sequences are chosen to be compatible with the expression host cell used. Polynucleotides encoding the light chain and the heavy chain domains of a PGT121 antibody variant or fragment thereof described herein can be inserted into separate vectors, or, optionally, both polynucleotides can be incorporated into the same expression vector using established techniques described herein or known in the art. A method for expressing the PGT121 antibody variant MS-414 is described in Example 6. This method, or similar methods, can be used for expression of one or more of the other PGT121 antibody variants or fragments thereof described herein.

In addition to polynucleotides encoding the heavy and light chains of a PGT121 antibody variant (or a polynucleotide encoding a single-chain polypeptide, an antibody fragment, such as a scFv molecule, or a construct described herein), the recombinant expression vectors described herein may carry regulatory sequences that control the expression of the antibody chain polynucleotides in a host cell. The design of the expression vector, including the selection of regulatory sequences, may depend on such factors as the choice of the host cell to be transformed or the level of expression of protein desired. For instance, suitable regulatory sequences for mammalian host cell expression include viral elements that direct high levels of protein expression in mammalian cells, such as promoters and/or enhancers derived from cytomegalovirus (CMV) (such as the CMV promoter/enhancer), Simian Virus 40 (SV40) (such as the SV40 promoter/enhancer), adenovirus, (e.g., the adenovirus major late promoter (AdMLP)) and polyoma. Viral regulatory elements, and sequences thereof, are described in detail, for instance, in U.S. Pat. Nos. 5,168,062, 4,510,245, and 4,968,615, the disclosures of each of which are incorporated herein by reference.

In addition to the antibody heavy and light chain polynucleotides and regulatory sequences, the recombinant expression vectors described herein can carry additional sequences, such as sequences that regulate replication of the vector in host cells (e.g., origins of replication) and selectable marker genes. A selectable marker gene facilitates selection of host cells into which the vector has been introduced (see e.g., U.S. Pat. Nos. 4,399,216, 4,634,665 and 5,179,017). For example, typically the selectable marker gene confers resistance to cytotoxic drugs, such as G418, puromycin, blasticidin, hygromycin or methotrexate, to a host cell into which the vector has been introduced. Suitable selectable marker genes include the dihydrofolate reductase (DHFR) gene (for use in DHFR⁻ host cells with methotrexate selection/amplification) and the neo gene (for G418 selection). In order to express the light and heavy chain domains of a PGT121 antibody or antigen-binding fragment thereof, the expression vector(s) containing polynucleotides encoding the heavy and light chain domains can be transfected into a host cell by standard techniques.

V. Antiretroviral Agents (ARVs) for Use in Combination with PGT121 Variant Antibodies In certain instances, a PGT121 variant antibody or fragment thereof featured herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) may be used in combination with one or more (e.g., 2, 3, 4, 5, 6, 7, 8, 9, 10, or more) antiretroviral agents (ARVs), such as, without limitation, any one or more ARVs set forth in Table 3 below.

TABLE 3

| Antiretroviral Agents | |
| --- | --- |
| Generic Name (Brand Name) | Class |
| efavirenz, emtricitabine and tenofovir disoproxil fumarate (Atripla) | Multi-class |
| emtricitabine, rilpivirine, and tenofovir disoproxil fumarate (Complera) | Multi-class |
| elvitegravir, cobicistat, emtricitabine, tenofovir disoproxil fumarate (Stribild) | Multi-class |
| lamivudine and zidovudine (Combivir) | NRTI |
| emtricitabine, FTC (Emtriva) | NRTI |
| lamivudine, 3TC (Epivir) | NRTI |
| abacavir and lamivudine (Ebzicom) | NRTI |
| zalcitabine, dideoxycytidine, ddC (Hivid) | NRTI |
| zidovudine, azidothymidine, AZT, ZDV (Retrovir) | NRTI |
| abacavir, zidovudine, and lamivudine (Trizivir) | NRTI |
| tenofovir disoproxil fumarate and emtricitabine (Truvada) | NRTI |
| enteric coated didanosine, ddI EC (Videx EC) | NRTI |
| didanosine, dideoxyinosine, ddI (Videx) | NRTI |
| tenofovir disoproxil fumarate, TDF (Viread) | NRTI |
| stavudine, d4T (Zerit) | NRTI |
| abacavir sulfate, ABC (Ziagen) | NRTI |
| Rilpivirine (Edurant) | NNRTI |
| Etravirine (Intelence) | NNRTI |
| delavirdine, DLV (Rescriptor) | NNRTI |
| efavirenz, EFV (Sustiva) | NNRTI |
| nevirapine, NVP (Viramune) | NNRTI |
| nevirapine, NVP (Viramune XR) | NNRTI |
| amprenavir, APV (Agenerase) | PI |
| tipranavir, TPV (Aptivus) | PI |
| indinavir, IDV (Crixivan) | PI |
| saquinavir (Fortovase) | PI |
| saquinavir mesylate, SQV (Invirase) | PI |

TABLE 3-continued

| Antiretroviral Agents | |
| --- | --- |
| Generic Name (Brand Name) | Class |
| lopinavir and ritonavir, LPV/RTV (Kaletra) | PI |
| Fosamprenavir Calcium, FOS-APV (Lexiva) | PI |
| ritonavir, RTV (Norvir) | PI |
| Darunavir (Prezista) | PI |
| atazanavir sulfate, ATV (Reyataz) | PI |
| nelfinavir mesylate, NFV (Viracept) | PI |
| enfuvirtide, T-20 (Fuzeon) | Fusion Inhibitor |
| maraviroc (Selzentry) | Entry Inhibitor-CCR5 co-receptor antagonist |
| raltegravir (Isentress) | HIV integrase strand transfer inhibitors |
| dolutegravir (Tivicay) | HIV integrase strand transfer inhibitors |

One or more of the above ARVs may be used (e.g., administered to a subject in need thereof) in combination with a PGT121 variant antibody or fragment thereof featured herein, and, optionally, one or more (e.g., 2, 3, 4, 5, 6, 7, 8, 9, 10, or more) HIV-specific broadly neutralizing antibody (bnAb), such as a CD4bs-specific antibody (e.g., 3BNC117 or VRC07-523), a V2 glycan-dependent antibody (e.g., CAP256-VRC26), and/or PGT121. According to the methods of the invention, one or more of the above ARVs may be administered to a subject (e.g., a human), either alone, or in combination with the bnAb, prior to, concurrently, and/or subsequent to administration of the antibody (e.g., a PGT121 variant antibody or fragment thereof) featured herein.

VI. Immunomodulators for Use in Combination with PGT121 Variant Antibodies

A PGT121 variant antibody or fragment thereof featured herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) may be used in combination with one or more (e.g., 2, 3, 4, 5, 6, 7, 8, 9, 10, or more) immunomodulators, such as, without limitation, any one or more immunomodulators set forth in Table 4 below.

TABLE 4

Exemplary Immunomodulators

Drug Name

AS-101
Bropirimine
Acemannan
CL246,738
EL10
FP-21399
Gamma Interferon
Granulocyte Macrophage Colony Stimulating Factor
HIV Core Particle Immunostimulant
Interleukin-2 (IL-2)
Immune Globulin Intravenous (human)
IMREG-1
IMREG-2
Imuthiol Diethyl Dithio Carbamate
Alpha-2 Interferon
Methionine-Enkephalin
MTP-PE Muramyl-Tripeptide
Granulocyte Colony Stimulating Factor
Remune
rCD4-IgG hybrids
Recombinant Soluble Human CD4
SK&F106528 Soluble T4
Thymopentin
Tumor Necrosis Factor
Infliximab One or more of the above immunomodulators may be used (e.g., administered to a subject in need thereof) in combination with a PGT121 variant antibody or fragment thereof featured herein, and, optionally, one or more (e.g., 2, 3, 4, 5, 6, 7, 8, 9, 10, or more) HIV-specific bnAb, such as a CD4bs-specific antibody (e.g., 3BNC117 or VRC07-523), a V2 glycan-dependent antibody (e.g., CAP256-VRC26), or PGT121, and/or one or more (e.g., 2, 3, 4, 5, 6, 7, 8, 9, 10, or more) ARVs. According to the methods of the invention, one or more of the above immunomodulators may be administered to a subject (e.g., a human), either alone, or in combination with the bnAb and/or the ARV, prior to, concurrently, and/or subsequent to administration of the PGT121 variant antibody or antigen-binding fragment thereof featured herein.

VI. Reservoir Activators for Use in Combination with PGT121 Variant Antibodies A PGT121 variant antibody or fragment thereof featured herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) may be used in combination with one or more (e.g., 2, 3, 4, 5, 6, 7, 8, 9, 10, or more) reservoir activators, such as, without limitation, any one or more immunomodulators described by Spivak and Planelles (Annu Rev Med, 69:421-436, 2018), Stoszko et al (EBioMedicine, 3:108-121, 2016), and Delagreverie et al (Open Forum Infectious Diseases, DOI: 10.1093/ofid/ofw189); incorporated herein by reference. Examples of reservoir activators that may be used in combination with a PGT121 variant antibody or fragment thereof featured herein are set forth in Table 5 below.

TABLE 5

Exemplary reservoir activators

| Class of agents | Agents |
| --- | --- |
| PKC agonists | (i) Phorbol esters, including phorbol 12-myristate 13-acetate (PMA), prostratin and 12-deoxyphorbol 13-phenylacetate (DPP); (ii) Macrocyclic lactones including bryostatin-1 and analogs (iii) Diterpenes, including ingenol compounds |
| Cytokines and chemokines | IL-7, IFN-α, IL-15 superagonist ALT-803 (IL-15N72D + IL-15RαSu/Fc fusion protein) |
| Toll-like receptor (TLR) agonists | (i) TLR 1/2 agonists, including Pam3CSK4 (ii) TLR3 agonists, including Poly-ICLC (iii) TLR5 agonists, including flagellin (iv) TLR7 agonists, including GS-9620 (v) TLR9 agonists, including MGN1703 and CpG7909 |
| Immune checkpoint inhibitors | Anti-PD-1 monoclonal antibodies, anti-PD-1 ligand (PD-L1) monoclonal antibodies, anti-CTLA-4 monoclonal antibodies |
| HDAC inhibitors | romidepsin, vorinostat, belinostat, LAQ824, panobinostat, entinostat, CI994, mocetinostat |
| Small molecules | (i) Disulfiram (ii) Benzotriazole derivatives, including 3-Hydroxy-1,2,3-benzotriazin-4((3H)-one (HO-DHBt) (iii) SMAC mimetics (iv) BRG-Brahma Associated Factor (BAF) inhibitors, including caffeic acid phenethyl ester and pyrimethamine |

One or more of the above reservoir activators may be used (e.g., administered to a subject in need thereof) in combination with a PGT121 variant antibody or fragment thereof featured herein, and, optionally, one or more (e.g., 2, 3, 4, 5, 6, 7, 8, 9, 10, or more) HIV-specific bnAb, such as a CD4bs-specific antibody (e.g., 3BNC117 or VRC07-523), a V2 glycan-dependent antibody (e.g., CAP256-VRC26), or PGT121, one or more (e.g., 2, 3, 4, 5, 6, 7, 8, 9, 10, or more) ARVs, and/or one or more (e.g., 2, 3, 4, 5, 6, 7, 8, 9, 10, or more) immunomodulators. According to the methods of the invention, one or more of the above reservoir activators may be administered to a subject (e.g., a human), either alone, or in combination with the bnAb, the ARV, and/or the immunomodulator, prior to, concurrently, and/or subsequent to administration of the PGT121 variant antibody or fragment thereof featured herein.

VII. Therapeutic Methods

The PGT121 variant antibodies or fragments thereof described herein (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and/or the heavy and light chain variable domains for these antibodies; and/or in which the antibodies retain the mutation(s) shown in Tables 1 and 2 for each respective antibody; in particular, MS-414) can be administered to a subject in need thereof to treat or block HIV infection in the subject. In particular, featured are methods of treating a subject (e.g., a human) infected with HIV (e.g., HIV-1), in which the methods include administering to the subject one or more of the PGT121 antibodies or antigen-binding fragments thereof described hereinabove. These methods are supported by the findings that the PGT121 variant antibodies or fragments thereof described hereinabove are capable of neutralizing pseudoviruses of HIV, such as RHPA4259.7, Du172.17, CNE52, 0260.v5.c36, SC05.8C11.2344, Ce1176_A3, SC422661.8, BB1012-11.TC21, 263-8, X1193_c1, AC10.0.29, and 6952.v1.c20.

Included are methods of blocking an HIV (e.g., HIV-1) infection in a subject (e.g., a human) at risk of HIV transmission by administering to the subject one or more of the PGT121 variant antibodies and/or antigen binding fragments thereof (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414). For example, in one aspect, the subject may be a fetus of an HIV-infected pregnant female and the method includes administering to the HIV-infected pregnant female one or more of the PGT121 variant antibodies or antigen-binding fragments thereof described hereinabove, thereby blocking the HIV infection in the fetus. In other instances, the subject is a newborn having an HIV-infected mother, a subject at risk of HIV transmission following a needlestick injury, or a subject at risk of HIV transmission following a sexual exposure to one or more HIV-infected individuals.

In instances when the subject is a fetus of an HIV-infected pregnant female, the HIV-infected pregnant female can be administered one or more of the PGT121 variant antibodies or antigen-binding fragments thereof described hereinabove following manifestation of one or more symptoms associated with pregnancy (e.g., a missed period, tender or swollen breasts, nausea with or without vomiting, increased urination, fatigue, and/or uncharacteristic food aversions or cravings), following a diagnosis of pregnancy, and/or in the third trimester of pregnancy, in order to block an HIV infection in the fetus.

In instances when the subject is a newborn having an HIV-infected mother, the newborn can be administered one or more of the PGT121 variant antibodies or antigen-binding fragments thereof described hereinabove peripartum and/or postpartum, for example, prior to, during, and/or following breastfeeding from the HIV-infected mother, in order to block an HIV infection in the newborn.

In instances when the subject is at risk of HIV transmission following a needlestick injury, the subject can be administered one or more of the PGT121 variant antibodies or antigen-binding fragments thereof described hereinabove less than 3 days following the needlestick injury, for example, 1, 2, 3, 4, 5, 6, 7, 8, 9, 10, 15, 20, 30, 35, 40, 45, 50, 55, or 60 minutes, 2, 4, 6, 10, 15, or 24 hours, 1.5, 2, or 2.5 days following the needlestick injury, in order to block an HIV infection in the subject. Alternatively, or additionally, the subject can be administered one or more of the PGT121 variant antibodies or antigen-binding fragments thereof described hereinabove between 3 to 14 days following the needlestick injury, for example, 3, 4, 5, 6, 7, 8, 9, 10, 11, 12, 13, or 14 days following the needlestick injury, in order to block an HIV infection in the subject.

In instances when the subject is at risk of HIV transmission following a sexual exposure to one or more HIV-infected individuals, the subject can be administered one or more of the PGT121 variant antibodies or antigen-binding fragments thereof described hereinabove less than 3 days following the sexual exposure, for example, 1, 2, 3, 4, 5, 6, 7, 8, 9, 10, 15, 20, 30, 35, 40, 45, 50, 55, or 60 minutes, 2, 4, 6, 10, 15, or 24 hours, 1.5, 2, or 2.5 days following the sexual exposure, in order to block an HIV infection in the subject. Alternatively, or additionally, the subject can be administered one or more of the PGT121 variant antibodies or antigen-binding fragments thereof described hereinabove between 3 to 14 days following the sexual exposure, for example, 3, 4, 5, 6, 7, 8, 9, 10, 11, 12, 13, or 14 days following the sexual exposure, in order to block an HIV infection in the subject.

In any of the methods of antibody therapy described above, the subject can have an undetectable plasma viral load, such as less than 3,500 RNA copies/ml (e.g., less than 2,000 RNA copies/ml, e.g., less than 400 RNA copies/ml, e.g., less than 50 RNA copies/ml, e.g., less than 1 RNA copy/ml), prior to commencement of antibody therapy. In such instances, the subject may already be on ARV. However, ARV alone, in contrast to the PGT121 variant antibodies or antigen-binding fragments thereof described hereinabove, is unable to reduce tissue reservoirs of the virus. Accordingly, the methods of the invention feature administration of one or more of the PGT121 variant antibodies or antigen-binding fragments thereof described hereinabove, alone or in combination with one or more (e.g., 2, 3, 4, 5, 6, 7, 8, 9, 10, or more) ARV, and/or one or more (e.g., 2, 3, 4, 5, 6, 7, 8, 9, 10, or more) HIV-specific bnAb (such as a CD4bs-specific antibody (e.g., 3BNC117 or VRC07-523), a V2 glycan-dependent antibody (e.g., CAP256-VRC26), and/or PGT121), as described in detail below, to treat a subject (e.g., a human) infected with HIV (e.g., HIV-1) or block an HIV infection in a subject at risk of HIV transmission, based, at least in part, on the finding that the PGT121 variant antibodies or fragments thereof described hereinabove are capable of neutralizing pseudoviruses of HIV, such as RHPA4259.7, Du172.17, CNE52, 0260.v5.c36, SC05.8C11.2344, Ce1176_A3, SC422661.8, BB1012-11.TC21, 263-8, X1193_c1, AC10.0.29, and 6952.v1.c20. Preferably, the subject either maintains or achieves an undetectable plasma viral load for at least about 2 months (e.g., at least about 3, 4, 5, 6, 7, 8, 9, 10, or 11 months, or 1, 2, 3, 4, 5, 6, 7, 8, 9, 10, 11, 12, 13, 14, 15, 16, 17, 18, 19, or 20 years) following administration of the PGT121 variant antibodies or fragments thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414). The reduction in plasma viral load may be in the absence of an ART, e.g., for a period of at least 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, or more after administration of the PGT121 variant antibody or antigen-binding fragment thereof.

In any of the methods described above, further administration of an immunomodulator (e.g., an agent, such as a protein or peptide, which is capable of increasing, inducing, or extending an immune response, e.g., a cell-mediated immune response and/or a humoral immune response, when administered to a subject, such as a human, e.g., a human infected with HIV or at risk of an HIV infection or transmission) is contemplated. For example, one or more immunomodulators (e.g., 2, 3, 4, 5, 6, 7, 8, 9, 10, or more immunomodulators) can be administered in conjunction with, e.g., prior to, concurrently with, subsequent to, or within the context of a treatment regimen that includes administration of a PGT121 variant antibody or fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414).

In any of the methods described above, further administration of a reservoir activator (e.g., one or more reservoir activators selected from Table 5) is contemplated. For example, one or more reservoir activators (e.g., 2, 3, 4, 5, 6, 7, 8, 9, 10, or more reservoir activators) can be administered in conjunction with, e.g., prior to, concurrently with, subsequent to, or within the context of a treatment regimen that includes administration of a PGT121 variant antibody or fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414).

In any of the methods described above, administration of one or more of the PGT121 variant antibodies or antigen-binding fragments thereof described hereinabove (e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414), alone or in combination with one or more (e.g., 2, 3, 4, 5, 6, 7, 8, 9, 10, or more) HIV-specific bnAb (such as a CD4bs-specific antibody (e.g., 3BNC117 or VRC07-523), a V2 glycan-dependent antibody (e.g., CAP256-VRC26), and/or PGT121), one or more (e.g., 2, 3, 4, 5, 6, 7, 8, 9, 10, or more) ARVs, one or more (e.g., 2, 3, 4, 5, 6, 7, 8, 9, 10, or more) reservoir activators, and/or one or more (e.g., 2, 3, 4, 5, 6, 7, 8, 9, 10, or more) immunomodulators may: (i) reduce proviral DNA to below about 1,000 DNA copies/$10^6$ cells (e.g., below about 900 DNA copies/$10^6$ cells, below about 800 DNA copies/$10^6$ cells, below about 700 DNA copies/$10^6$ cells, below about 600 DNA copies/$10^6$ cells, below about 500 DNA copies/$10^6$ cells, below about 400 DNA copies/$10^6$ cells, below about 300 DNA copies/$10^6$ cells, below about 200 DNA copies/$10^6$ cells, below about 100 DNA copies/$10^6$ cells, below about 90 DNA copies/$10^6$ cells, below about 80 DNA copies/$10^6$ cells, below about 70 DNA copies/$10^6$ cells, below about 60 DNA copies/$10^6$ cells, below about 50 DNA copies/$10^6$ cells, below about 40 DNA copies/$10^6$ cells, below about 30 DNA copies/$10^6$ cells, below about 20 DNA copies/$10^6$ cells, below about 10 DNA copies/$10^6$ cells, below about 9 DNA copies/$10^6$ cells, below about 8 DNA copies/$10^6$ cells, below about 7 DNA copies/$10^6$ cells, below about 6 DNA copies/$10^6$ cells, below about 5 DNA copies/$10^6$ cells, below about 4 DNA copies/$10^6$ cells, below about 3 DNA copies/$10^6$ cells, below about 2 DNA copies/$10^6$ cells, below about 1 DNA copy/$10^6$ cells, or to an undetectable level) in a tissue (e.g., lymph node tissue, gastrointestinal tissue, peripheral blood) of the subject relative to an untreated control; (ii) increase HIV-specific cell-mediated immune response and/or humoral immune response in the subject relative to an untreated control; (iii) decrease viral replication in the subject relative to an untreated control; and/or (iv) reduce the plasma viral load to less than 3,500 RNA copies/ml (e.g., less than 3,000 RNA copies/ml, less than 2,500 RNA copies/ml, less than 2,000 RNA copies/ml, less than 1,500 RNA copies/ml, less than 1,000 RNA copies/ml, less than 550 RNA copies/ml, less than 500 RNA copies/ml, less than 450 RNA copies/ml, less than 400 RNA copies/ml, less than 350 RNA copies/ml, less than 300 RNA copies/ml, less than 250 RNA copies/ml, less than 200 RNA copies/ml, less than 150 RNA copies/ml, less than 100 RNA copies/ml, less than 50 RNA copies/ml, less than 40 RNA copies/ml, less than 30 RNA copies/ml, less than 20 RNA copies/ml, less than 10 RNA copies/ml, less than 9 RNA copies/ml, less than 8 RNA copies/ml, less than 7 RNA copies/ml, less than 6 RNA copies/ml, less than 5 RNA copies/ml, less than 4 RNA copies/ml, less than 3 RNA copies/ml, less than 2 RNA copies/ml, less than 1 RNA copy/ml, or to an undetectable level) relative to an untreated control. In some instances, following administration of one or more of the PGT121 variant antibodies or antigen-binding fragments thereof described hereinabove, alone or in combination with one or more (e.g., 2, 3, 4, 5, 6, 7, 8, 9, 10, or more) HIV-specific bnAb (such as a CD4bs-specific antibody (e.g., 3BNC117 or VRC07-523), a V2 glycan-dependent antibody (e.g., CAP256-VRC26), and/or PGT121), one or more (e.g., 2, 3, 4, 5, 6, 7, 8, 9, 10, or more) ARVs, one or more (e.g., 2, 3, 4, 5, 6, 7, 8, 9, 10, or more) reservoir activators, and/or one or more (e.g., 2, 3, 4, 5, 6, 7, 8, 9, 10, or more) immunomodulators, the subject has an undetectable plasma viral load for at least 2 months (e.g., at least 3 months, at least 4 months, at least 5 months, at least 6 months, at least 7 months, at least 8 months, at least 9 months, at least 10 months, at least 11 months, at least 1 year, at least 2 years, at least 3 years, at least 4 years, at least 5 years, at least 6 years, at least 7 years, at least 8 years, at least 9 years, at least 10 years, at least 11 years, at least 12 years, at least 13 years, at least 14 years, at least 15 years, at least 16 years, at least 17 years, at least 18 years, at least 19 years, at least 20 years, or more).

As described below in more detail, in any of the methods described above, the HIV therapy (e.g., HIV-1 therapy) may be concluded following administration of at least one dose (e.g., 2, 3, 4, 5, 6, 7, 8, 9, 10, or more doses) of the PGT121 variant antibody or antigen-binding fragment thereof described hereinabove, alone or in combination with one or more (e.g., 2, 3, 4, 5, 6, 7, 8, 9, 10, or more) HIV-specific bnAb (such as a CD4bs-specific antibody (e.g., 3BNC117 or VRC07-523), a V2 glycan-dependent antibody (e.g., CAP256-VRC26), and/or PGT121), one or more (e.g., 2, 3, 4, 5, 6, 7, 8, 9, 10, or more) ARVs, one or more (e.g., 2, 3, 4, 5, 6, 7, 8, 9, 10, or more) reservoir activators, and/or one or more (e.g., 2, 3, 4, 5, 6, 7, 8, 9, 10, or more) immunomodulators, following a duration of time post-therapy (e.g., at least two months or longer). The subject (e.g., a human infected with HIV or at risk of HIV transmission) can be monitored post-therapy to confirm that they exhibit and/or maintain virologic control in the absence of any intervening therapies, which, optionally, can be determined based upon measurements made from a biological sample of the subject (e.g., a measurement of proviral DNA level in a tissue and/or plasma viral load). If the subject exhibits and/or maintains virologic control during this post-therapy period, the subject may be taken off one or more, or all, HIV therapies indefinitely or until such time as the subject begins to exhibit loss of virologic control.

Methods of Administration and Dosage

For any of the methods described above, the one or more (e.g., 2, 3, 4, 5, 6, 7, 8, 9, 10, or more) PGT121 variant antibodies or antigen-binding fragments thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414), can be formulated, dosed, and administered in a fashion consistent with good medical practice. Antibody therapy may be performed alone or in conjunction with another therapy (e.g., ARV therapy or administration of a reservoir activator), and may be provided at home, the doctor's office, a clinic, a hospital's outpatient department, or a hospital. Antibody therapy optionally begins at a hospital so that the doctor can observe the therapy's effects closely and make any adjustments that are needed, or it may begin on an outpatient basis.

The dosage administered can be selected based on the subject to be treated (e.g., the age, body weight, capacity of the immune system, and general health of the subject being treated), the form of administration (e.g., as a solid or liquid), the manner of administration (e.g., by injection, inhalation, dry powder propellant), and the cells targeted (e.g., mucosal cells, epithelial cells, such as blood vessel epithelial cells, nasal epithelial cells, or pulmonary epithelial cells). Additionally, pharmacogenomic (the effect of genotype on the pharmacokinetic, pharmacodynamic, or efficacy profile of a therapeutic) information about a particular subject may affect the dosage used. Antibody therapy of the invention is preferably administered in an amount that provides a sufficient level of the PGT121 variant antibody or antigen-binding fragment thereof to yield a therapeutic effect in the subject without undue adverse physiological effects caused by treatment.

The PGT121 variant antibody or antigen-binding fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414), can be administered to a subject (e.g., a human infected with HIV and/or at risk of HIV transmission) intramuscularly, intravenously, intradermally, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctival, intravesicularly, mucosally, intrapericardially, intraumbilically, intraocularally, orally, topically, locally, by inhalation, by injection, by infusion, by continuous infusion, by localized perfusion bathing target cells directly, by catheter, by lavage, in cremes, or in lipid compositions, in accord with known methods. For example, the PGT121 variant antibody or antigen-binding fragment thereof described hereinabove can be administered by infusion, such as by continuous infusion, mucosally or subcutaneously. Alternatively, it is envisioned that the PGT121 variant antibody or antigen-binding fragment thereof described hereinabove may be delivered by gene therapy.

For any of the methods described above, a single dose of the PGT121 variant antibody or antigen-binding fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) can be administered to the subject. The single dose may be of a single PGT121 variant antibody or antigen-binding fragment thereof described hereinabove or of more than one antibody (i.e., an antibody cocktail including multiple antibodies or antigen-binding fragments thereof described hereinabove). In some instances, HIV therapy (e.g., HIV-1 therapy) may be concluded following the administration of the single dose of the PGT121 variant antibody or fragment thereof described hereinabove. In some instances, the single dose may be administered along with one or more (e.g., 2, 3, 4, 5, 6, 7, 8, 9, 10, or more) ARVs, such as one or more of the ARVs listed in Table 3 above, wherein the ARV is administered concurrently, prior to (e.g., 1 year, 9 months, 6 months, 3 months, 1 month, 3 weeks, 2 weeks, 1 week, 5 days, 3 days, 1 day, 18 hours, 12 hours, 6 hours, or 1 hour prior to), and/or subsequent to (e.g., 1 year, 9 months, 6 months, 3 months, 1 month, 3 weeks, 2 weeks, 1 week, 5 days, 3 days, 1 day, 18 hours, 12 hours, 6 hours, or 1 hour subsequent to) the single dose of the PGT121 variant antibody or fragment thereof described hereinabove. Accordingly, HIV therapy can, in some instances, be concluded following the administration of the ARV subsequent to the single dose of the PGT121 variant antibody or fragment thereof described hereinabove.

Alternatively, or additionally, the single dose may be administered along with a one or more (e.g., 2, 3, 4, 5, 6, 7, 8, 9, 10, or more) HIV-specific bnAb (such as a CD4bs-specific antibody (e.g., 3BNC117 or VRC07-523), a V2 glycan-dependent antibody (e.g., CAP256-VRC26), and/or PGT121), wherein the HIV-specific bnAb is administered concurrently, prior to (e.g., 1 year, 9 months, 6 months, 3 months, 1 month, 3 weeks, 2 weeks, 1 week, 5 days, 3 days, 1 day, 18 hours, 12 hours, 6 hours, or 1 hour prior to), and/or subsequent to (e.g., 1 year, 9 months, 6 months, 3 months, 1 month, 3 weeks, 2 weeks, 1 week, 5 days, 3 days, 1 day, 18 hours, 12 hours, 6 hours, or 1 hour subsequent to) the single dose of the PGT121 variant antibody or fragment thereof described hereinabove, alone, or in combination with one or more ARV. Accordingly, HIV therapy can, in some instances, be concluded following the administration of the HIV-specific bnAb (e.g., 3BNC117, VRC07-523, CAP256-VRC26, or PGT121) subsequent to the single dose of the PGT121 variant antibody or fragment thereof described hereinabove.

Alternatively, or additionally, the single dose may be administered along with a one or more (e.g., 2, 3, 4, 5, 6, 7, 8, 9, 10, or more) immunomodulators (e.g., one or more immunomodulators selected from Table 4), wherein the immunomodulator is administered concurrently, prior to (e.g., 1 year, 9 months, 6 months, 3 months, 1 month, 3 weeks, 2 weeks, 1 week, 5 days, 3 days, 1 day, 18 hours, 12 hours, 6 hours, or 1 hour prior to), and/or subsequent to (e.g., 1 year, 9 months, 6 months, 3 months, 1 month, 3 weeks, 2 weeks, 1 week, 5 days, 3 days, 1 day, 18 hours, 12 hours, 6 hours, or 1 hour subsequent to) the single dose of the PGT121 variant antibody or fragment thereof described hereinabove, alone, or in combination with one or more ARV, and/or HIV-specific bnAb (e.g., 3BNC117, VRC07-523, CAP256-VRC26, or PGT121). Accordingly, HIV therapy can, in some instances, be concluded following the administration of the immunomodulator subsequent to the single dose of the PGT121 variant antibody or fragment thereof described hereinabove.

Alternatively, or additionally, the single dose may be administered along with a one or more (e.g., 2, 3, 4, 5, 6, 7, 8, 9, 10, or more) reservoir activators (e.g., one or more reservoir activators selected from Table 5), wherein the reservoir activator is administered concurrently, prior to (e.g., 1 year, 9 months, 6 months, 3 months, 1 month, 3 weeks, 2 weeks, 1 week, 5 days, 3 days, 1 day, 18 hours, 12 hours, 6 hours, or 1 hour prior to), and/or subsequent to (e.g., 1 year, 9 months, 6 months, 3 months, 1 month, 3 weeks, 2 weeks, 1 week, 5 days, 3 days, 1 day, 18 hours, 12 hours, 6 hours, or 1 hour subsequent to) the single dose of the PGT121 variant antibody or fragment thereof described hereinabove, alone, or in combination with one or more ARV, HIV-specific bnAb (e.g., 3BNC117, VRC07-523, CAP256-VRC26, or PGT121), and/or immunomodulators. Accordingly, HIV therapy can, in some instances, be concluded following the administration of the reservoir activators subsequent to the single dose of the PGT121 variant antibody or fragment thereof described hereinabove.

In other instances, the method includes administering a first regimen including one or more doses (e.g., 2, 3, 4, 5, 6, 7, 8, 9, 10, or more doses) of the PGT121 variant antibody or fragment thereof described hereinabove (e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) and a second regimen including one or more doses (e.g., 2, 3, 4, 5, 6, 7, 8, 9, 10, or more doses) of the PGT121 variant antibody or fragment thereof described hereinabove, wherein the second regimen is administered at least about 2 months (e.g., at least about 3, 4, 5, 6, 7, 8, 9, 10, or 11 months, or 1, 2, 3, 4, 5, 6, 7, 8, 9, 10, 11, 12, 13, 14, 15, 16, 17, 18, 19, or 20 years) after the first regimen. The duration of time between the first and second regimens is preferably a longer duration of time than necessary for viral rebound to occur in a subject (e.g., a human) infected with HIV (e.g., HIV-1) under current standard of care (e.g., ART), which is approximately two months. Thus, the second regimen of the PGT121 variant antibody or fragment thereof described hereinabove can be considered a maintenance dose, and in some instances, HIV therapy may be concluded following the administration of the second regimen of the PGT121 variant antibody or fragment thereof described hereinabove. In some instances, the method can further include administering one or more (e.g., 1, 2, 3, 4, or 5 or more) ARV, such as one or more of the ARVs listed in Table 3 above, wherein the ARV is administered concurrently, prior to, and/or subsequent to the first regimen and/or the second regimen of the PGT121 variant antibody or fragment thereof described hereinabove. Accordingly, HIV therapy can, in some instances, be concluded following the administration of the ARV subsequent to the second regimen of the PGT121 variant antibody or fragment thereof described hereinabove.

Alternatively, or additionally, the first and second regimens may be administered along with a HIV-specific bnAb, such as CD4bs-specific antibodies (e.g., 3BNC117 or VRC07-523), V2 glycan-dependent antibodies (e.g., CAP256-VRC26), and/or PGT121. Accordingly, HIV therapy can, in some instances, be concluded following the administration of the HIV-specific bnAb (e.g., 3BNC117, VRC07-523, CAP256-VRC26, or PGT121) subsequent to second regimen of the PGT121 variant antibody or fragment thereof described hereinabove. Alternatively, or additionally, the first and second regimens may be administered along with an immunomodulator, such as one or more of the immunomodulators listed in Table 4 above. Accordingly, HIV therapy can, in some instances, be concluded following the administration of the immunomodulator subsequent to second regimen of the PGT121 variant antibody or fragment thereof described hereinabove. Alternatively, or additionally, the first and second regimens may be administered along with a reservoir activator, such as one or more of the reservoir activators listed in Table 5 above. Accordingly, HIV therapy can, in some instances, be concluded following the administration of the reservoir activator subsequent to second regimen of the PGT121 variant antibody or fragment thereof described hereinabove.

For any of the methods described above, the PGT121 variant antibody or fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) can be administered to the subject in a unit dose form or as a dose per mass or weight of the subject from about 0.01 mg/kg to about 100 mg/kg (e.g., 0.01-0.1 mg/kg, e.g., 0.02 mg/kg, 0.03 mg/kg, 0.04 mg/kg, 0.05 mg/kg, 0.06 mg/kg, 0.07 mg/kg, 0.08 mg/kg, 0.09 mg/kg, 0.1 mg/kg, e.g., 0.1-1 mg/kg, e.g., 0.2 mg/kg, 0.3 mg/kg, 0.4 mg/kg, 0.5 mg/kg, 0.6 mg/kg, 0.7 mg/kg, 0.8 mg/kg, 0.9 mg/kg, 1 mg/kg, e.g., 1-10 mg/kg, e.g., 1 mg/kg, 2 mg/kg, 3 mg/kg, 4 mg/kg, 5 mg/kg, 6 mg/kg, 7 mg/kg, 8 mg/kg, 9 mg/kg, 10 mg/kg, e.g., 10-100 mg/kg, e.g., 20 mg/kg, 30 mg/kg, 40 mg/kg, 50 mg/kg, 60 mg/kg, 70 mg/kg, 80 mg/kg, 90 mg/kg, 100 mg/kg). The PGT121 variant antibody or fragment thereof described hereinabove can be administered to the subject at a dose of about 0.01-100 mg/kg (e.g., 0.02-100 mg/kg, 0.03-100 mg/kg, 0.04-mg/kg, 0.05-100 mg/kg, 0.06-100 mg/kg, 0.07-100 mg/kg, 0.08-100 mg/kg, 0.09-100 mg/kg, 0.1-90 mg/kg, 0.1-80 mg/kg, 0.1-70 mg/kg, 0.1-60 mg/kg, 0.1-50 mg/kg, 0.5-50 mg/kg, 0.5-40 mg/kg, 0.5-30 mg/kg, 0.5-20 mg/kg, 0.5-10 mg/kg, 0.5-5 mg/kg, or 0.5-1 mg/kg) per mass or weight of the subject. For any of the methods described above, 0.01-5000 mg (e.g., 0.01-4500 mg, 0.01-4000 mg, 0.01-3500 mg, 0.01-3000 mg, 0.01-2500 mg, 0.01-2000 mg, 0.01-1500 mg, 0.01-1000 mg, 0.05-1000 mg, 0.1-1000 mg, 0.1-500 mg, 0.5-500 mg, 0.5-450 mg, 0.5-400 mg, 0.5-350 mg, 0.5-300 mg, 0.5-250 mg, 0.5-200 mg, 0.5-150 mg, 0.5-100 mg, 0.5-50 mg, 0.5-45 mg, 0.5-40 mg, 0.5-35 mg, 0.5-30 mg, 0.5-25 mg, 0.5-20 mg, 0.5-15 mg, 0.5-10 mg, or 1-10 mg) of the PGT121 variant antibody or fragment thereof described hereinabove can be administered to the subject.

The PGT121 variant antibody or fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) may be administered to the subject two or more times, such as one or more times hourly, daily (e.g., once daily for up to six days), weekly, every two weeks, every three weeks, every four weeks, monthly, every two months, every three months, every six months, or every year. The method may further include administering a second dose of the PGT121 variant antibody or fragment thereof described hereinabove to the subject one week, two weeks, three weeks, four weeks, or five weeks after administration of a first dose of the PGT121 variant antibody or fragment thereof described hereinabove. The method may also include administering more than two doses (e.g., three, four, five, six, seven, eight, nine, ten, or more doses) of the PGT121 variant antibody or fragment thereof to the subject. The administration of the PGT121 variant antibody or fragment thereof described hereinabove can be repeated at such a frequency for a certain period of time, followed by a period without treatment. Such repeated administrations can occur over a course of therapy lasting a specified length of time (e.g., at least 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, 6 years, 7 years, 8 years, 9 years, 10 years, or more).

In some of the methods of the invention, HIV (e.g., HIV-1) therapy is concluded following a determination that the proviral DNA level in tissue of the subject (as assessed, e.g., by biopsy) is reduced to an undetectable level. The method can result in a reduction of proviral DNA level in tissue of the subject relative to an amount of proviral DNA level in tissue of the subject before the administration of the PGT121 variant antibody or fragment thereof described hereinabove, or relative to an untreated control. For example, the proviral DNA level in tissue (e.g., lymph node tissue, gastrointestinal tissue, and/or peripheral blood) may be reduced to an undetectable level, such as below about 1,000 DNA copies/$10^6$ cells (e.g., below about 100 DNA copies/$10^6$ cells, e.g., below about 10 DNA copies/$10^6$ cells, e.g., below about 1 DNA copy/$10^6$ cells). Thus, a definitive end to HIV therapy can be determined based upon measurements made from a biological sample of the subject and/or time post-administration of the PGT121 variant antibody or fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414).

According to any one of the methods of the invention described herein, the PGT121 variant antibody or fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414) can be administered as a pharmaceutical composition. The pharmaceutical composition has the antibody or antigen-binding fragment thereof alone, or in combination with one or more (e.g., 2, 3, 4, 5, 6, 7, 8, 9, 10, or more) ARV (e.g., one or more ARVs selected from Table 3), one or more (e.g., 2, 3, 4, 5, 6, 7, 8, 9, 10, or more) immunomodulators (e.g., one or more immunomodulators selected from Table 4), one or more (e.g., 2, 3, 4, 5, 6, 7, 8, 9, 10, or more) reservoir activators (e.g., one or more reservoir activators selected from Table 5), and/or one or more (e.g., 2, 3, 4, 5, 6, 7, 8, 9, 10, or more) HIV-specific bnAb (e.g., 3BNC117, VRC07-523, CAP256-VRC26, or PGT121). The pharmaceutical composition has the antibody or antigen-binding fragment thereof in an amount of about 0.01-5000 mg (e.g., 0.01-4000 mg, 0.01-3000 mg, 0.01-2000 mg, 0.01-1000 mg, 0.05-1000 mg, 0.05-500 mg, 0.05-400 mg, 0.05-300 mg, 0.05-200 mg, 0.05-100 mg, 0.1-100 mg, 0.1-90 mg, 0.1-80 mg, 0.1-70 mg, 0.1-60 mg, 0.1-50 mg, 0.1-40 mg, 0.1-30 mg, 0.1-20 mg, 0.1-10 mg, 0.1-9 mg, 0.1-8 mg, 0.1-7 mg, 0.1-6 mg, 0.1-5 mg, 0.1-4 mg, 0.1-3 mg, 0.1-2 mg, or 0.1-1 mg). The pharmaceutical composition with the antibody or antigen-binding fragment thereof may be formulated in a volume of about 1000 ml or less (e.g., 950 ml or less, 900 ml or less, 850 ml or less, 800 ml or less, 750 ml or less, 700 ml or less, 650 ml or less, 600 ml or less, 550 ml or less, 500 ml or less, 450 ml or less, 400 ml or less, 350 ml or less, 300 ml or less, 250 ml or less, 200 ml or less, 150 ml or less, 100 ml or less, 50 ml or less, 25 ml or less, 20 ml or less, 15 ml or less, 10 ml or less, 5 ml or less, 1 ml or less, or 0.1 ml or less). The pharmaceutical composition with the PGT121 variant antibody or antigen-binding fragment thereof may be formulated in a volume of about 900 ml, 850 ml, 800 ml, 750 ml, 700 ml, 650 ml, 600 ml, 550 ml, 500 ml, 450 ml, 400 ml, 350 ml, 300 ml, 250 ml, 200 ml, 150 ml, 100 ml, 50 ml, 25 ml, 20 ml, 15 ml, 10 ml, 9 ml, 8 ml, 7 ml, 6 ml, 5 ml, 4 ml, 3 ml, 2 ml, 1 ml, 0.5 ml, 0.1 ml, 0.05 ml, or 0.01 ml. The pharmaceutical composition with the PGT121 variant antibody or antigen-binding fragment thereof may be formulated in a volume of about 0.1-10 ml (e.g., 0.1-9 ml, 0.1-8 ml, 0.1-7 ml, 0.1-6 ml, 0.1-5 ml, 0.1-4 ml, 0.1-3 ml, 0.1-2 ml, or 0.1-1 ml)

Methods of formulating pharmaceutical agents are known in the art, e.g., Niazi, Handbook of Pharmaceutical Manufacturing Formulations (Second Edition), CRC Press 2009, describes formulation development for liquid, sterile, compressed, semi-compressed and OTC forms. Transdermal and mucosal delivery, lymphatic system delivery, nanoparticles, controlled drug release systems, theranostics, protein and peptide drugs, and biologics delivery are described in Wang et al., Drug Delivery: Principles and Applications (Second Edition), Wiley 2016; formulation and delivery of peptide and protein agent is described, e.g., in Banga, Therapeutic Peptides and Proteins: Formulation, Processing, and Delivery Systems (Third Edition), CRC Press 2015. The pharmaceutical composition may be formulated to release the PGT121 variant antibody or fragment thereof described hereinabove immediately upon administration (e.g., targeted delivery) or at any predetermined time period after administration using controlled or extended release formulations. Administration of the pharmaceutical composition in controlled or extended release formulations is useful where the composition, either alone or in combination, has (i) a narrow therapeutic index (e.g., the difference between the plasma concentration leading to harmful side effects or toxic reactions and the plasma concentration leading to a therapeutic effect is small; generally, the therapeutic index, TI, is defined as the ratio of median lethal dose ($LD_{50}$) to median effective dose ($ED_{50}$)); (ii) a narrow absorption window at the site of release (e.g., the gastro-intestinal tract); or (iii) a short biological half-life, so that frequent dosing during a day is required in order to sustain a therapeutic level.

Many strategies can be pursued to obtain controlled or extended release in which the rate of release outweighs the rate of metabolism of the pharmaceutical composition. For example, controlled release can be obtained by the appropriate selection of formulation parameters and ingredients, including, e.g., appropriate controlled release compositions and coatings. Suitable formulations are known to those of skill in the art. Examples include single or multiple unit tablet or capsule compositions, oil solutions, suspensions, emulsions, microcapsules, microspheres, nanoparticles, patches, and liposomes.

The pharmaceutical compositions may be sterilized by conventional sterilization techniques, or may be sterile filtered. The resulting aqueous solutions may be packaged for use as is or lyophilized. The lyophilized preparation may be administered in powder form or combined with a sterile aqueous carrier prior to administration. The pH of the preparations typically will be between 3 and 11, more preferably between 5 and 9 or between 6 and 8, and most preferably between 7 and 8, such as 7 to 7.5. The resulting pharmaceutical compositions in solid form may, for example, be packaged in multiple single-dose units, each containing a fixed amount of the PGT121 variant antibody or fragment thereof described hereinabove, and, if desired, one or more immunomodulatory agents, reservoir activators, HIV-specific bnAbs (such as CD4bs-specific antibodies (e.g., 3BNC117 or VRC07-523), V2 glycan-dependent antibody (e.g., CAP256-VRC26), and/or PGT121), and/or ARVs, such as in a sealed package of tablets or capsules, or in a suitable dry powder inhaler (DPI) capable of administering one or more doses.

The pharmaceutical compositions, including an PGT121 variant antibody or fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414), can be prepared using standard methods known in the art by mixing the active ingredient (i.e., the PGT121 variant antibody or antigen-binding fragment thereof described hereinabove) having the desired degree of purity with, optionally, pharmaceutically acceptable carriers, excipients, or stabilizers (*Remington's Pharmaceutical Sciences* ($20^{th}$ edition), ed. A. Gennaro, 2000, Lippincott, Williams & Wilkins, Philadelphia, Pa.). Acceptable carriers, include saline, or buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagines, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, PLURONICS™, or PEG.

The PGT121 variant antibody or fragment thereof described hereinabove (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414), can be administered in a pharmaceutical composition that includes one or more pharmaceutically acceptable carriers, excipients, or diluents. Examples of suitable carriers, excipients, or diluents include, e.g., saline, sterile water, polyalkylene glycols, oils of vegetable origin, hydrogenated napthalenes, suitable buffer, 1,3-butanediol, Ringer's solution and/or sodium chloride solution. Exemplary formulations for parenteral administration include solutions prepared in water suitably mixed with a surfactant, e.g., hydroxypropylcellulose. Dispersions can also be prepared in glycerol, liquid polyethylene glycols, DMSO and mixtures thereof with or without alcohol, and in oils. Under ordinary conditions of storage and use, these preparations may contain a preservative to prevent the growth of microorganisms. Other exemplary carriers, excipients, or diluents are described in the Handbook of Pharmaceutical Excipients, 6th Edition, Rowe et al., Eds., Pharmaceutical Press (2009), hereby incorporated by reference in its entirety.

A pharmaceutical composition can be formulated to be compatible with its intended route of administration. Solutions or suspensions used for parenteral, intradermal, or subcutaneous application includes the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, or phosphate buffered saline (PBS). In all cases, the composition must be sterile and should be fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, and sodium chloride in the composition. Prolonged absorption of the injectable compositions can be brought about by including in the composition an agent which delays absorption, for example, aluminum monostearate and gelatin.

Sterile injectable solutions can be prepared by incorporating the PGT121 variant antibody or fragment thereof (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414), in the required amount in an appropriate solvent with one or a combination of ingredients enumerated above, as required, followed by filtered sterilization. Dispersions can be prepared by incorporating the PGT121 variant antibody or antigen-binding fragment thereof into a sterile vehicle which contains a basic dispersion medium and the required other ingredients from those enumerated above. In the case of sterile powders for the preparation of sterile injectable solutions, the preferred methods of preparation can be vacuum drying and freeze-drying which yields a powder of the PGT121 variant antibody or antigen-binding fragment thereof plus any additional desired ingredient from a previously sterile-filtered solution thereof.

Oral compositions may include an inert diluent or an edible carrier. The composition can be enclosed in a gelatin capsule or compressed into a tablet. For the purpose of oral therapeutic administration, the PGT121 variant antibody or fragment thereof (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414), can be incorporated with excipients and used in the form of tablets, troches, or gelatin capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, or corn starch; a lubricant such as magnesium stearate; a glidant such as colloidal silicon dioxide; a sweetening agent such as sucrose or saccharin; or a flavoring agent such as peppermint, methyl salicylate, or orange flavoring.

Systemic administration can also be by transmucosal or transdermal means. For transmucosal or transdermal administration, penetrants appropriate to the barrier to be permeated can be used in the formulation. Such penetrants are generally known, and include, for example, for transmucosal administration, detergents, bile salts, and fusidic acid derivatives. Transmucosal administration can be accomplished through the use of nasal sprays or suppositories. For transdermal administration, the antibody or antigen-binding fragment thereof may be formulated into ointments, salves, gels, or creams as generally known in the art.

The PGT121 variant antibody or fragment thereof (such as, e.g., MS-22, MS-46, MS-47, MS-48, MS-49, MS-50, MS-51, MS-52, MS-53, MS-54, MS-55, MS-56, MS-57, MS-23, MS-24, MS-25, MS-44, MS-26, MS-27, MS-28, MS-29, MS-30, MS-31, MS-32, MS-36, MS-37, MS-40, MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445 (e.g., MS-399, MS-400, MS-401, MS-402, MS-403, MS-404, MS-405, MS-406, MS-407, MS-408, MS-409, MS-410, MS-411, MS-412, MS-413, MS-414, MS-437, MS-438, MS-439, MS-440, MS-441, MS-442, MS-443, MS-444, and MS-445), and variants thereof having at least 90%, 95%, 97%, 99%, sequence identity to, or the sequence of, one or more of the heavy and light chain CDR sequences for these antibodies and/or the heavy and light chain variable domains for these antibodies; and/or in which the antibodies retain the mutation(s) shown in Tables 1 and 2 for each respective antibody; in particular, MS-414), can be prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Liposomal suspensions can also be used as pharmaceutically acceptable carriers. These can be prepared according to methods known to those skilled in the art.

The pharmaceutical compositions can be included in a container, pack, or dispenser together with instructions for administration.

Optionally, but preferably, the formulation contains a pharmaceutically acceptable salt, preferably sodium chloride, and preferably at about physiological concentrations. Optionally, the formulations of the invention can contain a pharmaceutically acceptable preservative. In some embodiments the preservative concentration ranges from 0.1 to 2.0%, typically v/v. Suitable preservatives include those known in the pharmaceutical arts. Benzyl alcohol, phenol, m-cresol, methylparaben, and propylparaben are preferred preservatives. Optionally, the formulations of the invention include a pharmaceutically acceptable surfactant at a concentration of 0.005 to 0.02%.

EXAMPLES

The present invention is illustrated by the following examples, which are in no way intended to be limiting of the invention.

Example 1. Generation of bNAbs

Materials and Methods

Antibody material was generated from transient expression of two suspension cell lines, Human Embryonic Kidney 293 (HEK293) and Chinese Hamster Ovary (CHO). The pTT5 mammalian expression vectors containing either a light chain (LC) or heavy chain (HC) coding region were co-transfected into HEK293 cells at a viable cell density (VCD) of $1 \times 10^6$ cells/mL using polyethyleneimine (PEI) (Durocher et al., *Nucleic Acids Res* 30(2):E9, 2002), and then two-fold diluted with pre-warmed medium to ⅕ shake flask volume. Expression duration was 5-7 days at 37° C., 5% $CO_2$, and 85% humidity at a shaking speed of 130 RPM with an orbit of 19 mm. All clarified supernatants were produced by pelleting the cells at 3000 g for 20 minutes followed by 0.22 µm filtration.

Antibodies were purified from the clarified supernatants using MABSELECT SURE™ protein A resin. A sodium phosphate, sodium chloride buffer system with an arginine wash and an acetate pH 3.5 elution was utilized. Protein A elutions were neutralized with tris, and buffer exchanged into 20 mM sodium phosphate, 150 mM NaCl, pH 7.4.

Size Exclusion High Performance Liquid Chromatography (SE-HPLC)

Size exclusion high performance liquid chromatography (SE-HPLC) was used to separate proteins based on differences in their hydrodynamic volumes. By this method, molecules with larger hydrodynamic protein volumes elute earlier than molecules with smaller volumes. Undiluted samples were loaded onto a Waters XBRIDGE® Protein BEH SEC 200A column (3.5 µm, 7.8×300 mm), separated isocratically with a running buffer (100 mM sodium phosphate and 250 mM sodium chloride, pH 6.8), and the eluent monitored by UV absorbance at 280 nm. Purity was determined by calculating the percentage of each separated component as compared to the total integrated area.

Differential Scanning Fluorimetry (DSF)

Differential scanning fluorimetry (DSF) is a high throughput technique that is used to estimate a protein's relative thermodynamic stability. Ranking of DSF results can be used as a tool to select candidates with more favorable stability properties. The DSF technique consists of measuring the fluorescence intensity of a hydrophobic probe at gradually increasing temperatures to determine the transition temperature and exposure of the hydrophobic regions of a protein. The measurements from this technique, reported as transition temperatures, correlate well with data obtained from differential scanning calorimetry (DSC). Thermal transition temperature(s) by DSF were measured according to the method of Feng et al. (*J Pharm Sci* 99: 1707-1720, 2010). Analysis was done in PBS buffer (20 mM sodium phosphate and 150 mM sodium chloride, pH 7.1) at a final protein concentration of 0.15 mg/ml and a final SYPRO® Orange concentration of 3×. Protein and SYPRO® Orange were mixed at 1:1 volumetric ratio in a 96-well PCR plate and analyzed using a Roche LIGHTCYCLER® 480 instrument equipped with Thermal Shift Analysis Software. Thermal curves were generated by heating the samples from 20-95° C. at a ramp rate of 4.4° C./s and 10 acquisitions per ° C. at Ex=465 nm Em=580 nm. Transition temperatures and shoulder scores were determined using the first derivative of the melting curve.

Low-pH Stability

The stability of proteins at low pH was determined as follows. The pH of protein samples (1 mg/ml in 20 mM PBS) was lowered to approximately pH 3.3 using 2 M acetic acid. After a 30 minute incubation, samples were neutralized to approximately pH 5.0 using 2 M tris base. Samples were measured in duplicates for high molecular weight species using the SE-HPLC method. As a control, protein samples had the same volume of PBS added as the 2 M acetic acid and 2 M tris base, and measured for high molecular weight species.

Relative Solubility

Solubility was assessed according to the method of Torprani et al. (*J Pharm Sci* 105: 2319-2327, 2016). Analysis was done in PBS buffer (20 mM sodium phosphate and 150 mM sodium chloride, pH 7.1) and a final PEG 10,000 concentration of 7.9%. Protein at 1 mg/ml was diluted into the PEG solution at 1:4 ratio, and incubated in a 96-well 0.22 μm filter plate overnight at room temperature. After PEG incubation, samples were passed through the filter by centrifugation, and the remaining soluble protein was measured by a protein A titer assay.

Chemical Unfolding

Thirty-two guanidine hydrochloride (GuHCl) concentrations in PBS ranging from 0 to 6 M GND were prepared using a liquid handling robot. Protein samples (1 mg/ml in 20 mM PBS) were then transferred to each GuHCl concentration to achieve a final protein concentration of 0.05 mg/ml. After a 24 hour incubation, the samples were measured on a SPECTRAMAX® M5 plate reader (excitation: 280 nm, emission: 300-450 nm). The measured fluorescence intensity at 373 nm was corrected for scattering and stray light by subtraction of a small amount of the summed intensity measured between 300-320 nm (used as a surrogate for signal due to scattering), and then ratioed to the total intensity measured between 320-440 nm to correct for total intensity fluctuations. Then, the chemical unfolding curve was generated by plotting each corrected intensity against the GuHCl concentration. The inflection point of the curve was calculated and reported for each protein sample from this curve. Samples were measured in triplicate.

Example 2. Development of Optimized PGT121 Variant Antibodies

A series of algorithms were applied to identify potentially destabilizing residues in the Fv region of the N332-glycan dependent antibody, PGT121. These residues by themselves, or in combination, lead to instability at low pH, increased susceptibility to chemical degradation, or increased aggregation during production or long term storage. Based on this analysis, a series of variants were designed for maintaining potency while optimizing desired characteristics using combinatorial residue replacement techniques. The optimization process was broken up into different stages, the first being identification of single residues in the framework region that are potentially responsible for destabilization. Based on the analysis, a series of variants were produced by transient expression, each containing a single residue modification of the identified amino acids, or in a few variants, combinations of amino acids based on their proximity to each other (Round-1 variants, Table 1). The variants were characterized for desired biophysical characteristics (Tables 6 and 7; FIG. 1), and retention of neutralization activity (Table 8; FIGS. 2A-2C). From the analysis, two residues at the light chain/heavy chain interface (LmdV:H30 and HV:R39) were identified that significantly reduced low-pH instability of PGT121. Additionally, five other distinct amino acid residues (LmdV:P61G, LmdV:T101K, HV:A27G, HV:S40P, and HV:V83S) were identified that showed an increase in desirable biophysical characteristics (FIGS. 3A, 3B), and did not impact neutralization. Together, the interface residues and the distinct single residues were used to produce a library of variants encompassing combinatorial residue replacements (Round-2 variants, Table 2; FIG. 4). The variants were again produced by transient expression and the purified combinatorial variants analyzed for retention of neutralization activity and for desired biophysical characteristics. From this combinatorial library a subset of variants were used to construct a library in which the heavy chain Fab glycan was removed from HV:N124. Together, the combinatorial libraries of variants allowed for identification of molecules with significantly increased low-pH stability (e.g., to pH 3.3), increased thermal stability (up to 95° C.), increased stability to chemical unfolding (e.g., to 0 to 6 M GuHCl, see Tables 6, 7, 9, and 10; FIG. 5), and retention of neutralization activity against several different HIV pseudoviruses (Tables 8, 11, and 12; FIGS. 6A, 6B). The variable domain residue positions were numbered according to the AHo structure-based numbering (Honegger and Plückthun, *J Mol Bio* 309: 657-670, 2001).

Example 3. Characterization of Round-1 PGT121 Variant Antibodies

Round-1 variants of PGT121 (Table 1) were produced by transient expression in HEK293 cells and purified by protein A chromatography. The antibodies were buffer exchanged into phosphate buffered saline and used for analysis. Assays used for analysis of the Round-1 variants included titer, size exclusion chromatography (SEC) to quantify high molecular weight (HMW) species and oligomers following purification (Table 6), DSF to characterize stability of the CH2 and Fab domains during thermal ramping, chemical unfolding by guanidine hydrochloride (GuHCl) for determining storage stability, PEG solubility to interrogate protein-protein interaction (Table 7), and retention of neutralization capacity (Table 8).

The monomer content of the variants ranged from a low of 62.1% to a high of 89.7% with the HMW species made up of dimers and oligomers. The majority of variants had Tm values, as determined by thermal unfolding, similar to the parental molecule, MS-42. However, a slight increase in Tm (by 0.7° C. and 0.8° C.) was noted in MS-36 and MS-37, suggesting a small increase in intramolecular stability.

This increase indeed correlated with an increase in intramolecular stability as determined by chemical unfolding, showing an increase of 0.34 M GuHCl and 0.29 M GuHCl in MS-36, and MS-37, respectively, over that observed for MS-42. Low pH stability is especially problematic for the native PGT121 antibody, which exhibits intrinsic instability upon exposure to acidic conditions. MS-42, PGT121 with and M87L and N93S mutations in the Fc domain of the heavy chains (SEQ ID NO: 1402), as recombinantly produced by Catalent, aggregated to 93% from an initial value of 14% upon low-pH incubation (pH 3.3). While a majority of the PGT121 variant antibodies showed results similar to MS-42, variants MS-36, MS-37 and MS-40 all showed significantly reduced levels of aggregation following lowpH incubation (Table 7). Other variants, such as MS-48, also aggregated to a lesser degree than MS-42, but not to the degree observed for MS-36, MS-37 and MS-40 (Table 7). Reduced aggregation has been shown to be linked to increased manufacturability and storage stability.

The variants were also assayed for retention of neutralization activity. Table 8 shows neutralization activity of Round-1 variants against 6 pseudoviruses of HIV, which are representative of the broader set of viruses against which the native PGT121 antibody is active. The PGT121 variant antibodies with more than 3-fold increase in the IC50 or IC80 values for a particular pseudovirus were considered inactive and discarded from further consideration. As evidenced by the data, three variants, MS-23, MS-44 and MS-53 lost neutralization activity. While MS-23 showed a loss of activity for specific viruses, the activity was recovered when paired with other amino acid changes so that only MS-44 and MS-53 were removed from further consideration.

Example 4. Characterization of Round-2 PGT121 Variant Antibodies

Round-2 variants were designed based on the combinatorial variants MS-36, MS-37, and MS-40, and the results of the single variants MS-51, MS-54 and MS-29 (see Table 5). The Round-2 variants built from these amino acids sets are listed in Table 2. All variants contained the double mutation LV:H30Q in the light chain variable domain (relative to SEQ ID NO: 1394) and HV:R39Q in the heavy chain variable domain (relative to SEQ ID NO: 1393), which was observed to increase the low-pH stability of the variants. The Round-2 variants can be divided into 2 distinct sets, with and without the glycan at position HV:N124, by introducing the mutation HV:N124Q into variants MS-437 through MS-445. Variants MS-399 to MS-414 all contained the native residue at position HV:N124 and showed full glycosylation at this site. A second site, HV:N68, also contained a putative glycosylation sequence, but MAM analysis of the parental molecule showed that this residue is not glycosylated, and hence, was not targeted in the second round of mutations. Assays used for analysis of the Round-2 variants included SEC to quantify monomer and HMW species following purification (Table 9), DSF to characterize stability of the CH2 and Fab domains during thermal ramping, chemical unfolding, low-pH stability, solubility (Table 8), and retention of neutralization capacity (Tables 11 and 12).

Results of the initial screening consisting of SEC analysis for dimer and oligomer content are shown in Table 9, while results for the DSF, low-pH stability, chemical unfolding and solubility are shown in Table 10. The dimer content was relatively unchanged for all variants relative to the parental molecule, MS-42, while all the variants showed a dramatic decrease in the oligomer content from 8.97% (shown by MS-42) to 0.2-0.4% (shown by Round-2 variants) (Table 9). The variants were also characterized by DSF to identify those with increased thermodynamic stability, as evidenced by the presence of distinct Tm2 unfolding temperatures. In order to better differentiate the variants by DSF, an alternative analysis of the data was devised that took advantage of the change between Tm1 and Tm2 and the area under the thermal unfolding curves. As evident from the WSS data in Table 10, the variants had increased values, which is indicative of greater stability.

Thermodynamic stability was also evaluated by assessing the chemical unfolding. Chemical unfolding, which shows the intrinsic resistance of the native state against unfolding, was measured by the mid-point of the denaturation curve; the values being positively correlated to stability (e.g., higher the value, greater the stability). Together with the DSF shoulder score, a much finer differentiation of the intrinsic thermodynamic stability of the antibodies was obtained. In addition to the intrinsic stability, the resistance to aggregation during low pH incubation, solubility, and neutralization activity of the variants was also investigated. While the MS-42 aggregated with up to 88% HMW formation, a number of the variants showed <15% HMW formation, with a few variants such as MS-414 and MS-444 showing as low as 3.44% and 5.13% HMW formation.

Overall, analysis of the Round-2 variants (outlined in Tables 9-12) showed significant increase in multiple stability characteristics including thermal stability, chemical stability, low-pH stability, and solubility, which are important for increased manufacturability and storage stability of the molecules.

TABLE 6

Analysis of biophysical characteristics of Round-1 PGT121 variant antibodies.

| Molecule Set | Titer (μg/ml) | SEC (% Main) | SEC (% Dimer) | SEC (% Oligomer) |
|---|---|---|---|---|
| MS-42 | 295.2 | 86.03 | 4.11 | 9.85 |
| MS-22 | 10.9 | 86.49 | 2.67 | 10.84 |
| MS-46 | 176.4 | 83.15 | 6.47 | 10.38 |
| MS-47 | 170.8 | 82.7 | 8.3 | 9 |
| MS-48 | 236.4 | 80.07 | 8.87 | 11.06 |
| MS-49 | 250.9 | 79.01 | 8.69 | 12.31 |
| MS-50 | 161.5 | 75.79 | 7.79 | 16.42 |
| MS-51 | 427.4 | 72.78 | 10.57 | 16.66 |
| MS-52 | 221.8 | 76.01 | 10.19 | 13.8 |
| MS-53 | 208 | 72.49 | 10 | 17.51 |
| MS-54 | 386.4 | 77.28 | 9.04 | 13.68 |
| MS-55 | 315.9 | 83.89 | 4.31 | 11.8 |
| MS-56 | 249.8 | 80.21 | 3.31 | 16.48 |
| MS-57 | 337.1 | 73.81 | 8.4 | 17.79 |
| MS-23 | 334.7 | 89.71 | 6.91 | 3.38 |
| MS-24 | 282.7 | 83.2 | 4.54 | 12.26 |
| MS-25 | 308.5 | 76.56 | 7.46 | 15.98 |
| MS-44 | 220.1 | 62.08 | 3.42 | 34.5 |
| MS-26 | 279.5 | 82.45 | 6.57 | 10.98 |
| MS-27 | 261.3 | 72.22 | 4.66 | 23.11 |
| MS-28 | 300 | 82.15 | 7.59 | 10.27 |
| MS-29 | 273 | 85.89 | 6.59 | 7.51 |
| MS-30 | 402.3 | 75.31 | 10.35 | 14.34 |
| MS-31 | 345.2 | 85.27 | 9.62 | 5.1 |
| MS-32 | 290.8 | 75.49 | 4.25 | 20.26 |
| MS-36 | 271.4 | 82.88 | 10.23 | 6.89 |
| MS-37 | 234.9 | 89.22 | 7.05 | 3.72 |
| MS-40 | 229.5 | 92.8 | 4.84 | 2.37 |

TABLE 7

Analysis of additional biophysical characteristics of Round-1 PGT121 variant antibodies.

| Molecule Set | DSF T1 ° C. (Avg. n = 2) | Std Dev | pH 3.3 HMW% (Avg n = 2) | Std Dev | Inflection Pt of Unfolding (Avg n = 3) | Std Dev | PEG solubility (avg. n = 4) | Std Dev |
|---|---|---|---|---|---|---|---|---|
| MS-42 | 69.5 | 0.02 | 92.67 | 0.99 | 2.15 | 0.00 | 0.128 | 0.013 |
| MS-22 | 69.7 | 0.03 | | | | | | |
| MS-46 | 69.9 | 0.12 | 93.65 | 3.78 | 2.17 | 0.03 | 0.115 | 0.013 |
| MS-47 | 69.0 | 0.04 | 94.34 | 2.98 | 2.04 | 0.02 | 0.123 | 0.010 |
| MS-48 | 69.3 | 0.08 | 68.39 | 9.61 | 2.16 | 0.03 | 0.128 | 0.013 |
| MS-49 | 69.9 | 0.07 | 92.81 | 4.11 | 2.15 | 0.02 | 0.113 | 0.010 |
| MS-50 | 68.4 | 0.01 | 93.61 | 2.31 | 2.03 | 0.02 | 0.110 | 0.014 |
| MS-51 | 69.9 | 0.14 | 93.29 | 3.21 | 2.21 | 0.04 | 0.103 | 0.010 |
| MS-52 | 69.2 | 0.04 | 93.12 | 3.00 | 2.12 | 0.01 | 0.115 | 0.006 |
| MS-53 | 70.4 | 0.06 | 83.12 | 3.06 | 2.31 | 0.08 | 0.123 | 0.010 |
| MS-54 | 69.8 | 0.05 | 93.17 | 3.15 | 2.08 | 0.02 | 0.120 | 0.008 |
| MS-55 | 69.4 | 0.06 | 94.60 | 2.19 | 2.11 | 0.03 | 0.143 | 0.005 |
| MS-56 | 69.4 | 0.03 | 95.90 | 2.57 | 2.14 | 0.02 | 0.125 | 0.029 |
| MS-57 | 69.1 | 0.22 | 96.31 | 1.74 | 2.07 | 0.03 | 0.103 | 0.010 |
| MS-23 | 69.9 | 0.10 | 77.16 | 8.08 | 2.28 | 0.02 | 0.150 | 0.014 |
| MS-24 | 69.3 | 0.16 | 95.59 | 1.53 | 2.16 | 0.03 | 0.143 | 0.005 |
| MS-25 | 69.3 | 0.06 | 92.62 | 1.51 | 2.08 | 0.01 | 0.143 | 0.017 |
| MS-44 | 68.8 | 0.00 | 94.87 | 1.01 | 1.98 | 0.01 | 0.115 | 0.006 |
| MS-26 | 69.4 | 0.06 | 88.39 | 3.59 | 2.14 | 0.03 | 0.140 | 0.008 |
| MS-27 | 69.2 | 0.01 | 94.66 | 1.11 | 2.02 | 0.04 | 0.105 | 0.017 |
| MS-28 | 69.5 | 0.11 | 91.43 | 2.74 | 2.19 | 0.09 | 0.115 | 0.013 |
| MS-29 | 69.5 | 0.11 | 89.73 | 3.64 | 2.14 | 0.01 | 0.148 | 0.010 |
| MS-30 | 69.5 | 0.16 | 92.49 | 1.47 | 2.15 | 0.03 | 0.115 | 0.013 |
| MS-31 | 68.6 | 0.20 | 86.77 | 3.44 | 2.16 | 0.04 | 0.120 | 0.012 |
| MS-32 | 69.4 | 0.04 | 95.70 | 0.91 | 2.12 | 0.01 | 0.125 | 0.006 |
| MS-36 | 70.3 | 0.03 | 15.33 | 1.69 | 2.49 | 0.02 | 0.145 | 0.006 |
| MS-37 | 70.2 | 0.01 | 32.18 | 0.12 | 2.44 | 0.03 | 0.143 | 0.013 |
| MS-40 | 68.3 | 0.03 | 35.31 | 1.58 | 2.18 | 0.01 | 0.103 | 0.013 |

TABLE 8

Analysis of neutralization activity of Round-1 PGT121 variant antibodies against representative PGT121 sensitive virus panel in TZM.bl cells. Loss of potency are values > 3-fold of control value.

| Molecule | RHPA4259.7 | | Du172.17 | | CNE52 | | 0260.v5.c36 | | SC05.8C11.2344 | | Ce1176_A3 | |
|---|---|---|---|---|---|---|---|---|---|---|---|---|
| Set | IC50 | IC80 | IC50 | IC80 | IC50 | IC80 | IC50 | IC80 | IC50 | IC80 | IC50 | IC80 |
| Control | 0.018 | 0.047 | 0.051 | 0.672 | 2.921 | 17.812 | 0.051 | 0.143 | 0.019 | 0.071 | 0.020 | 0.076 |
| MS-22 | 0.031 | 0.133 | 0.092 | 0.193 | 1.949 | 16.364 | 0.125 | 0.336 | 0.028 | 0.096 | 0.038 | 0.143 |
| MS-46 | 0.014 | 0.046 | 0.031 | 0.221 | 2.491 | 20.227 | 0.046 | 0.163 | 0.009 | 0.040 | 0.019 | 0.069 |
| MS-47 | 0.018 | 0.047 | 0.043 | 0.300 | 2.205 | 18.494 | 0.034 | 0.128 | 0.016 | 0.048 | 0.017 | 0.061 |
| MS-48 | 0.013 | 0.034 | 0.020 | 0.165 | 2.813 | 21.935 | 0.021 | 0.108 | 0.016 | 0.063 | 0.009 | 0.036 |
| MS-49 | 0.016 | 0.053 | 0.050 | 0.324 | 2.917 | 24.145 | 0.050 | 0.187 | 0.014 | 0.054 | 0.016 | 0.047 |
| MS-50 | 0.016 | 0.051 | 0.060 | 0.374 | 3.548 | >25 | 0.080 | 0.221 | 0.021 | 0.061 | 0.021 | 0.079 |
| MS-51 | 0.013 | 0.043 | 0.024 | 0.082 | 1.440 | 12.698 | 0.048 | 0.146 | 0.015 | 0.046 | 0.007 | 0.028 |
| MS-52 | 0.022 | 0.070 | 0.057 | 0.360 | 4.116 | >25 | 0.052 | 0.159 | 0.022 | 0.060 | 0.017 | 0.067 |
| MS-53* | 0.066 | 0.457 | 3.364 | >25 | >25 | >25 | 0.130 | 1.039 | 0.462 | 2.506 | 0.034 | 0.156 |
| MS-54 | 0.014 | 0.046 | 0.077 | 0.549 | 3.653 | 22.531 | 0.050 | 0.172 | 0.028 | 0.080 | 0.023 | 0.107 |
| MS-55 | 0.023 | 0.070 | 0.135 | 0.960 | 4.331 | >25 | 0.055 | 0.190 | 0.023 | 0.080 | 0.019 | 0.086 |
| MS-56 | 0.014 | 0.036 | 0.046 | 0.150 | 1.928 | 13.452 | 0.022 | 0.078 | 0.016 | 0.044 | 0.009 | 0.031 |
| MS-57 | 0.006 | 0.016 | 0.009 | 0.041 | 0.787 | 3.688 | 0.008 | 0.022 | 0.006 | 0.017 | 0.003 | 0.011 |
| MS-23* | 0.014 | 0.038 | 0.060 | 0.521 | 2.310 | 24.404 | 0.056 | 0.153 | 0.016 | 0.059 | 0.080 | 0.371 |
| MS-24 | 0.007 | 0.032 | 0.054 | 0.428 | 1.902 | 19.144 | 0.057 | 0.150 | 0.019 | 0.068 | 0.020 | 0.091 |
| MS-25* | 0.082 | 0.368 | 2.457 | 22.090 | >25 | >25 | 1.239 | 6.165 | 0.172 | 0.796 | 0.137 | 0.604 |
| MS-44* | 0.268 | 1.915 | 1.693 | 13.844 | >25 | >25 | 4.383 | 24.10 | 0.088 | 0.608 | 0.438 | 1.937 |
| MS-26 | 0.014 | 0.039 | 0.036 | 0.422 | 2.669 | 18.719 | 0.040 | 0.143 | 0.020 | 0.075 | 0.016 | 0.058 |
| MS-27 | 0.025 | 0.080 | 0.146 | 2.075 | 6.478 | >25 | 0.078 | 0.276 | 0.036 | 0.128 | 0.036 | 0.130 |
| MS-28 | 0.010 | 0.030 | 0.037 | 0.432 | 2.557 | 17.829 | 0.031 | 0.112 | 0.020 | 0.072 | 0.009 | 0.046 |
| MS-29 | 0.009 | 0.043 | 0.041 | 0.293 | 2.321 | >25 | 0.040 | 0.191 | 0.021 | 0.071 | 0.023 | 0.081 |
| MS-30 | 0.012 | 0.035 | 0.049 | 0.366 | 2.165 | 21.250 | 0.053 | 0.181 | 0.023 | 0.082 | 0.023 | 0.080 |
| MS-31 | 0.010 | 0.037 | 0.052 | 0.400 | 2.142 | 21.646 | 0.053 | 0.178 | 0.020 | 0.068 | 0.016 | 0.071 |
| MS-32 | 0.008 | 0.031 | 0.034 | 0.267 | 1.536 | 24.271 | 0.057 | 0.189 | 0.016 | 0.057 | 0.015 | 0.052 |
| MS-36 | 0.008 | 0.037 | 0.062 | 1.716 | 2.657 | >25 | 0.040 | 0.182 | 0.019 | 0.066 | 0.013 | 0.063 |
| MS-37 | 0.011 | 0.037 | 0.038 | 1.096 | 1.836 | 23.830 | 0.047 | 0.131 | 0.014 | 0.050 | 0.015 | 0.072 |
| MS-40 | 0.006 | 0.025 | 0.046 | 0.360 | 2.216 | 22.199 | 0.043 | 0.149 | 0.014 | 0.050 | 0.009 | 0.033 |

Assay Set up: mAbs tested at primary concentration of 25 ug/ml and titrated 5-fold 7x (duplicate wells)

TABLE 9

Analysis of biophysical characteristics of Round-2 PGT121 variant antibodies.

| Molecule Set | SEC (% monomer) | SEC (% dimer) | SEC (% Oligomer) |
|---|---|---|---|
| MS-42 | 88.6 | 2.41 | 8.97 |
| MS-399 | 97.2 | 2.39 | 0.39 |
| MS-400 | 98.1 | 1.61 | 0.34 |
| MS-401 | 97.8 | 1.83 | 0.33 |
| MS-402 | 98.3 | 1.49 | 0.2 |
| MS-403 | 98.0 | 1.77 | 0.24 |
| MS-404 | 98.1 | 1.68 | 0.23 |
| MS-405 | 98.1 | 1.71 | 0.23 |
| MS-406 | 97.8 | 1.96 | 0.28 |
| MS-407 | 98.1 | 1.59 | 0.31 |
| MS-408 | 98.1 | 1.59 | 0.34 |
| MS-409 | 97.7 | 1.98 | 0.3 |
| MS-410 | 97.9 | 1.84 | 0.28 |
| MS-411 | 97.7 | 2.01 | 0.28 |
| MS-412 | 98.3 | 1.44 | 0.31 |
| MS-413 | 98.2 | 1.4 | 0.41 |
| MS-414 | 98.5 | 1.19 | 0.26 |
| MS-437 | 98.5 | 1.32 | 0.19 |
| MS-438 | 97.8 | 1.87 | 0.34 |
| MS-439 | 98.3 | 1.44 | 0.29 |
| MS-440 | 98.1 | 1.62 | 0.31 |
| MS-441 | 99.0 | 0.8 | 0.22 |
| MS-442 | 97.9 | 1.79 | 0.34 |
| MS-443 | 98.3 | 1.37 | 0.3 |
| MS-444 | 98.2 | 1.45 | 0.31 |
| MS-445 | 98.5 | 1.2 | 0.3 |

TABLE 10

Analysis of additional biophysical characteristics of Round-2 PGT121 variant antibodies.

| Molecule Set | WSS (Avg. n = 2) | Std Dev | Inflection Pt of Unfolding (Avg n = 3) | Std Dev | pH 3.3 HMW% (Avg n = 2) | Std Dev | PEG solubility (avg. n = 2) | Std Dev |
|---|---|---|---|---|---|---|---|---|
| MS-42 | 5.72 | 0.25 | 2.06 | 0.02 | 88.44 | 2.15 | 0.132 | 0.009 |
| MS-399 | 6.20 | 0.09 | 2.16 | 0.05 | 18.96 | 3.26 | 0.150 | 0.007 |
| MS-400 | 9.16 | 0.40 | 2.32 | 0.10 | 11.95 | 0.28 | 0.149 | 0.006 |
| MS-401 | 7.05 | 0.93 | 2.32 | 0.02 | 20.08 | 2.69 | 0.154 | 0.005 |
| MS-402 | 6.63 | 0.08 | 2.46 | 0.05 | 24.0 | 22.4 | 0.169 | 0.011 |
| MS-403 | 6.82 | 0.96 | 2.29 | 0.04 | 12.61 | 5.16 | 0.176 | 0.008 |
| MS-404 | 6.90 | 0.53 | 2.41 | 0.02 | 10.71 | 5.18 | 0.172 | 0.011 |
| MS-405 | 6.35 | 0.03 | 2.39 | 0.02 | 19.86 | 1.40 | 0.157 | 0.011 |
| MS-406 | 6.70 | 0.24 | 2.36 | 0.02 | 11.05 | 0.95 | 0.155 | 0.007 |
| MS-407 | 16.16 | 0.30 | 2.45 | 0.04 | 11.94 | 3.05 | 0.133 | 0.010 |
| MS-408 | 13.08 | 1.25 | 2.45 | 0.00 | 6.64 | 0.66 | 0.156 | 0.007 |
| MS-409 | 7.73 | 0.93 | 2.23 | 0.09 | 11.84 | 2.22 | 0.156 | 0.012 |
| MS-410 | 9.66 | 1.83 | 2.18 | 0.03 | 10.66 | 0.85 | 0.174 | 0.010 |
| MS-411 | 6.92 | 0.22 | 2.40 | 0.03 | 8.08 | 0.80 | 0.153 | 0.006 |
| MS-412 | 11.56 | 0.39 | 2.50 | 0.02 | 6.19 | 1.63 | 0.145 | 0.009 |
| MS-413 | 8.10 | 0.56 | 2.29 | 0.07 | 4.2 | 0.08 | 0.155 | 0.011 |
| MS-414 | 11.97 | 1.38 | 2.48 | 0.08 | 3.44 | 0.48 | 0.166 | 0.008 |
| MS-437 | 10.3 | 0.60 | 2.44 | 0.06 | 20.75 | 16.48 | 0.138 | 0.004 |
| MS-438 | 5.3 | 0.66 | 2.40 | 0.01 | 18.83 | 11.50 | 0.178 | 0.009 |
| MS-439 | 6.1 | 1.32 | 2.32 | 0.02 | 34.66 | 6.17 | 0.175 | 0.005 |
| MS-440 | 5.3 | 0.33 | 2.30 | 0.03 | 28.71 | 5.69 | 0.173 | 0.007 |
| MS-441 | 9.5 | 1.78 | 2.50 | 0.01 | 23.58 | 0.08 | 0.144 | 0.010 |
| MS-442 | 10.7 | 2.25 | 2.54 | 0.08 | 10.34 | 2.12 | 0.150 | 0.004 |
| MS-443 | 12.7 | 1.23 | 2.48 | 0.08 | 9.60 | 2.38 | 0.145 | 0.014 |
| MS-444 | 14.5 | 0.38 | 2.70 | 0.07 | 5.13 | 0.72 | 0.158 | 0.016 |
| MS-445 | 11.9 | 0.12 | 2.50 | 0.01 | 9.75 | 8.53 | 0.155 | 0.007 |

TABLE 11

Analysis of neutralization activity of selected Round-2 PGT121 variant antibodies against representative PGT121 sensitive virus panel in TZM.bl cells. Loss of potency are values >3-fold of control value.

| Molecule Set | SC422661.8 | | RHPA4259.7 | | Du172.17 | | BB1012-11.TC21 | | CNE52 | | 0260.v5.c36 | |
|---|---|---|---|---|---|---|---|---|---|---|---|---|
| | IC50 | IC80 | IC50 | IC80 | IC50 | IC80 | IC50 | IC80 | IC50 | IC80 | IC50 | IC80 |
| Control | 0.028 | 0.126 | 0.011 | 0.033 | 0.013 | 0.198 | 0.005 | 0.021 | 0.904 | 16.834 | 0.027 | 0.105 |
| MS-399 | 0.014 | 0.098 | 0.007 | 0.028 | 0.021 | 0.304 | 0.007 | 0.026 | 1.319 | >25 | 0.023 | 0.108 |
| MS-400 | 0.017 | 0.060 | 0.007 | 0.025 | 0.009 | 0.126 | 0.006 | 0.018 | 0.858 | 12.804 | 0.021 | 0.074 |
| MS-401 | 0.025 | 0.089 | 0.013 | 0.046 | 0.026 | 0.383 | 0.006 | 0.022 | 2.709 | 24.412 | 0.034 | 0.160 |
| MS-402 | 0.020 | 0.095 | 0.010 | 0.039 | 0.039 | 0.403 | 0.005 | 0.020 | 2.867 | 23.665 | 0.030 | 0.114 |
| MS-403 | 0.020 | 0.096 | 0.008 | 0.033 | 0.031 | 0.266 | 0.003 | 0.018 | 2.055 | >25 | 0.025 | 0.104 |
| MS-404 | 0.034 | 0.149 | 0.009 | 0.035 | 0.039 | 0.539 | 0.006 | 0.022 | 0.888 | 18.344 | 0.039 | 0.139 |

TABLE 11-continued

Analysis of neutralization activity of selected Round-2 PGT121 variant antibodies against representative PGT121 sensitive virus panel in TZM.bl cells. Loss of potency are values >3-fold of control value.

| Molecule | SC422661.8 | | RHPA4259.7 | | Du172.17 | | BB1012-11.TC21 | | CNE52 | | 0260.v5.c36 | |
|---|---|---|---|---|---|---|---|---|---|---|---|---|
| Set | IC50 | IC80 | IC50 | IC80 | IC50 | IC80 | IC50 | IC80 | IC50 | IC80 | IC50 | IC80 |
| MS-405 | 0.021 | 0.091 | 0.006 | 0.024 | 0.022 | 0.401 | 0.005 | 0.021 | 0.685 | 23.215 | 0.038 | 0.133 |
| MS-406 | 0.024 | 0.105 | 0.005 | 0.031 | 0.034 | 0.427 | 0.004 | 0.018 | 1.754 | 23.505 | 0.040 | 0.141 |
| MS-407 | 0.017 | 0.079 | 0.003 | 0.015 | 0.011 | 0.079 | 0.002 | 0.013 | 0.756 | 11.444 | 0.022 | 0.080 |
| MS-408 | 0.016 | 0.064 | 0.008 | 0.033 | 0.013 | 0.103 | 0.007 | 0.020 | 1.503 | 22.352 | 0.026 | 0.095 |
| MS-409 | 0.017 | 0.068 | 0.011 | 0.034 | 0.033 | 0.429 | 0.008 | 0.025 | 2.386 | >25 | 0.043 | 0.119 |
| MS-410 | 0.019 | 0.074 | 0.007 | 0.030 | 0.044 | 0.372 | 0.007 | 0.024 | 2.930 | >25 | 0.045 | 0.126 |
| MS-411 | 0.056 | 0.184 | 0.004 | 0.027 | 0.017 | 0.614 | 0.007 | 0.026 | 2.070 | 19.759 | 0.036 | 0.130 |
| MS-412 | 0.019 | 0.072 | 0.009 | 0.028 | 0.014 | 0.104 | 0.003 | 0.015 | 0.858 | 10.022 | 0.014 | 0.067 |
| MS-413 | 0.010 | 0.040 | 0.008 | 0.024 | 0.009 | 0.127 | 0.002 | 0.011 | 0.499 | 11.664 | 0.017 | 0.076 |
| MS-414 | 0.010 | 0.054 | 0.006 | 0.023 | 0.014 | 0.159 | 0.003 | 0.014 | 1.003 | 13.830 | 0.013 | 0.056 |
| MS-437 | 0.017 | 0.084 | 0.006 | 0.019 | 0.005 | 0.075 | 0.005 | 0.015 | 0.468 | 8.746 | 0.017 | 0.070 |
| MS-438 | 0.032 | 0.108 | 0.009 | 0.035 | 0.011 | 0.163 | 0.005 | 0.021 | 1.150 | 11.393 | 0.026 | 0.108 |
| MS-439 | 0.024 | 0.115 | 0.010 | 0.037 | 0.018 | 0.262 | 0.007 | 0.024 | 1.754 | 20.803 | 0.030 | 0.089 |
| MS-440 | 0.020 | 0.093 | 0.009 | 0.032 | 0.011 | 0.160 | 0.007 | 0.024 | 2.083 | 21.432 | 0.038 | 0.114 |
| MS-441 | 0.011 | 0.057 | 0.007 | 0.027 | 0.005 | 0.062 | 0.006 | 0.017 | 0.921 | 17.785 | 0.026 | 0.099 |
| MS-442 | 0.015 | 0.069 | 0.006 | 0.024 | 0.007 | 0.062 | 0.005 | 0.015 | 0.540 | 8.680 | 0.012 | 0.067 |
| MS-443 | 0.015 | 0.070 | 0.008 | 0.028 | 0.010 | 0.075 | 0.004 | 0.019 | 0.700 | 9.577 | 0.021 | 0.075 |
| MS-444 | 0.014 | 0.049 | 0.007 | 0.026 | 0.007 | 0.144 | 0.005 | 0.018 | 0.454 | 14.615 | 0.017 | 0.061 |
| MS-445 | 0.011 | 0.050 | 0.006 | 0.023 | 0.004 | 0.087 | 0.003 | 0.016 | 0.550 | 18.542 | 0.019 | 0.074 |

Assay Set up: mAbs tested at primary concentration of 25 ug/ml and titrated 5-fold 7x (duplicate wells).

TABLE 12

Analysis of neutralization activity of selected Round-2 PGT121 variant antibodies against additional representative PGT121 sensitive virus panel in TZM.bl cells. Loss of potency are values > 3-fold of control value.

| Molecule | 263-8 | | SC05.8C11.2344 | | X1193_c1 | | Ce1176_A3 | | AC10.0.29 | | 6952.v1.c20 | |
|---|---|---|---|---|---|---|---|---|---|---|---|---|
| Set | IC50 | IC80 | IC50 | IC80 | IC50 | IC80 | IC50 | IC80 | IC50 | IC80 | IC50 | IC80 |
| Control | 1.121 | 9.368 | 0.018 | 0.084 | 0.019 | 0.065 | 0.018 | 0.049 | 0.033 | 0.117 | 0.053 | 0.373 |
| MS-399 | 0.667 | 7.514 | 0.022 | 0.081 | 0.017 | 0.076 | 0.014 | 0.041 | 0.029 | 0.099 | 0.039 | 0.265 |
| MS-400 | 0.202 | 1.982 | 0.007 | 0.038 | 0.019 | 0.065 | 0.011 | 0.027 | 0.028 | 0.077 | 0.017 | 0.078 |
| MS-401 | 1.313 | 9.462 | 0.017 | 0.066 | 0.020 | 0.066 | 0.016 | 0.044 | 0.034 | 0.118 | 0.054 | 0.240 |
| MS-402 | 1.157 | 7.914 | 0.018 | 0.065 | 0.019 | 0.065 | 0.015 | 0.041 | 0.034 | 0.115 | 0.071 | 0.456 |
| MS-403 | 0.836 | 5.956 | 0.017 | 0.064 | 0.024 | 0.104 | 0.014 | 0.039 | 0.039 | 0.137 | 0.060 | 0.395 |
| MS-404 | 0.767 | 6.845 | 0.016 | 0.058 | 0.016 | 0.078 | 0.015 | 0.044 | 0.041 | 0.141 | 0.053 | 0.367 |
| MS-405 | 0.672 | 4.884 | 0.019 | 0.088 | 0.010 | 0.047 | 0.011 | 0.031 | 0.025 | 0.084 | 0.056 | 0.363 |
| MS-406 | 0.458 | 6.263 | 0.017 | 0.060 | 0.017 | 0.079 | 0.012 | 0.032 | 0.029 | 0.101 | 0.057 | 0.368 |
| MS-407 | 0.101 | 1.733 | 0.006 | 0.027 | 0.012 | 0.056 | 0.010 | 0.030 | 0.026 | 0.089 | 0.012 | 0.057 |
| MS-408 | 0.205 | 2.042 | 0.016 | 0.049 | 0.020 | 0.068 | 0.011 | 0.030 | 0.028 | 0.078 | 0.022 | 0.076 |
| MS-409 | 1.136 | 8.638 | 0.030 | 0.087 | 0.021 | 0.070 | 0.018 | 0.051 | 0.036 | 0.097 | 0.075 | 0.329 |
| MS-410 | 0.922 | 6.852 | 0.029 | 0.081 | 0.022 | 0.073 | 0.016 | 0.037 | 0.034 | 0.092 | 0.086 | 0.559 |
| MS-411 | 0.825 | 6.263 | 0.027 | 0.064 | 0.022 | 0.075 | 0.017 | 0.039 | 0.038 | 0.108 | 0.045 | 0.310 |
| MS-412 | 0.159 | 1.524 | 0.014 | 0.044 | 0.023 | 0.067 | 0.013 | 0.030 | 0.024 | 0.071 | 0.018 | 0.063 |
| MS-413 | 0.198 | 1.855 | 0.013 | 0.040 | 0.015 | 0.055 | 0.011 | 0.026 | 0.021 | 0.060 | 0.015 | 0.065 |
| MS-414 | 0.167 | 1.715 | 0.010 | 0.043 | 0.014 | 0.049 | 0.010 | 0.028 | 0.020 | 0.073 | 0.016 | 0.064 |
| MS-437 | 0.202 | 1.296 | 0.014 | 0.050 | 0.016 | 0.053 | 0.011 | 0.026 | 0.020 | 0.091 | 0.015 | 0.069 |
| MS-438 | 0.619 | 6.754 | 0.020 | 0.069 | 0.025 | 0.083 | 0.014 | 0.033 | 0.032 | 0.107 | 0.062 | 0.408 |
| MS-439 | 0.886 | 8.660 | 0.014 | 0.054 | 0.018 | 0.063 | 0.016 | 0.045 | 0.028 | 0.099 | 0.051 | 0.238 |
| MS-440 | 0.953 | 8.835 | 0.014 | 0.053 | 0.018 | 0.063 | 0.015 | 0.042 | 0.035 | 0.120 | 0.053 | 0.238 |
| MS-441 | 0.250 | 2.605 | 0.009 | 0.034 | 0.015 | 0.051 | 0.011 | 0.026 | 0.020 | 0.069 | 0.020 | 0.069 |
| MS-442 | 0.178 | 1.676 | 0.007 | 0.032 | 0.014 | 0.048 | 0.011 | 0.026 | 0.018 | 0.060 | 0.016 | 0.073 |
| MS-443 | 0.120 | 0.955 | 0.011 | 0.033 | 0.012 | 0.054 | 0.009 | 0.027 | 0.021 | 0.074 | 0.014 | 0.051 |
| MS-444 | 0.154 | 1.532 | 0.011 | 0.035 | 0.009 | 0.043 | 0.009 | 0.027 | 0.017 | 0.059 | 0.015 | 0.071 |
| MS-445 | 0.144 | 1.211 | 0.010 | 0.031 | 0.006 | 0.036 | 0.007 | 0.028 | 0.018 | 0.063 | 0.014 | 0.065 |

Assay Set up: mAbs tested at primary concentration of 25 ug/ml and titrated 5-fold 7x (duplicate wells)

Example 5. Purification and Viral Inactivation of PGT121 and Optimized Variant Antibodies Performance of the combinatorial variants in a standardized purification model was investigated using materials produced by transient expression in a CHO-S system. Following a 14 day production and centrifugation to remove cells and cellular debris, supernatant was depth filtered and the antibody purified on a MABSELECT SURE™ protein A chromatography column. Low pH viral inactivation was performed for 60 min at pH 3.5 using a sample of protein A eluate. Following low pH viral inactivation, the sample was neutralized to pH 5.0 and assayed by HP-SEC. The remaining protein A elution pool was titrated to pH 5.0 and loaded onto FRACTOGEL® EMD SO$_3^-$ strong cation exchange column that was eluted using a linear gradient of sodium chloride. Generated CEX product pool was buffer exchanged into an acetate buffer at pH 5.2 with 9% sucrose. As depicted in Table 13, the optimized variant antibodies (e.g., MS-414 and MS-444) showed significant reduction in HMW and oligomer formation compared to the parental molecules.

TABLE 13

Analysis of performance of PGT121 and optimized variant antibodies

| Molecule set | Pool | % Main | % HMW | % Oligomer |
|---|---|---|---|---|
| MS-43 (Parental) | PrA Pool | 97.1 | 2.0 | 0.88 |
| | NVIP | 57.9 | 4.6 | 37.1 |
| MS-42 (Parental-LS) | PrA Pool | 97.5 | 1.9 | 0.62 |
| | PrA Pool | 53.8 | 4.9 | 40.9 |
| MS-414 | PrA Pool | 91.7 | 6.2 | 2.1 |
| | NVIP | 92.5 | 5.7 | 1.6 |
| MS-444 | PrA Pool | 70.7 | 15.4 | 13.9 |
| | NVIP | 73.4 | 13.8 | 12.8 |

Figure 7:
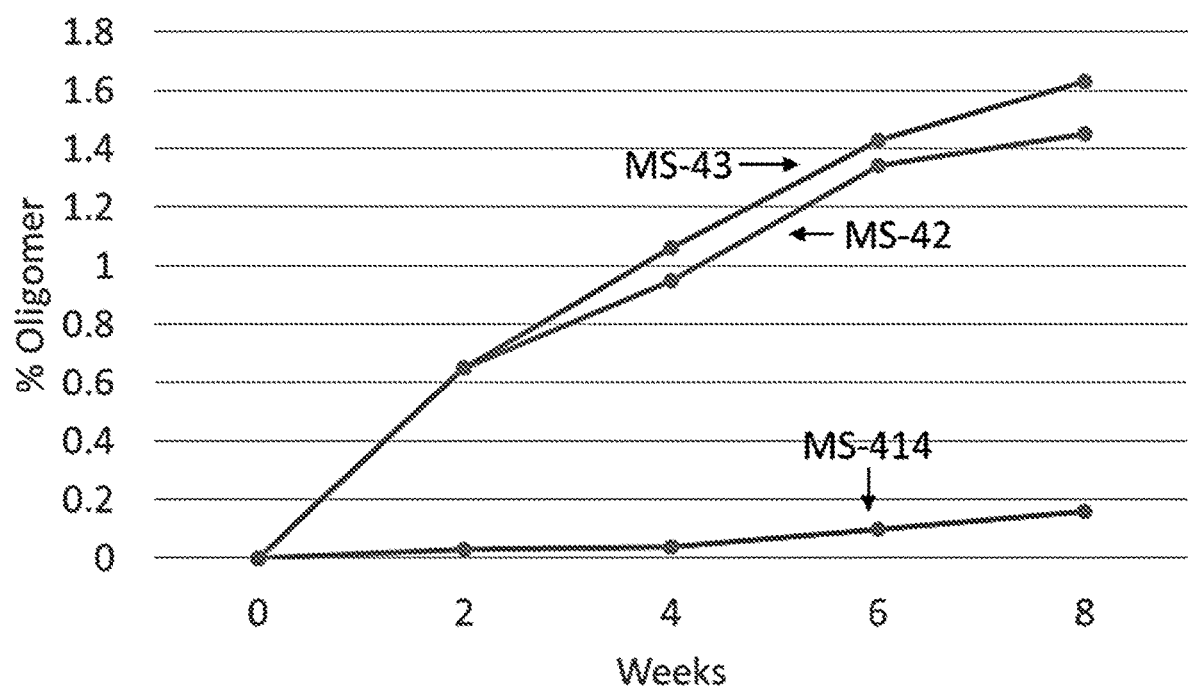
FIG. 7 is a graph showing the stability of MS-42, MS-43 and MS-414 at 40° C. over a period of 8 weeks.
Figure 8:
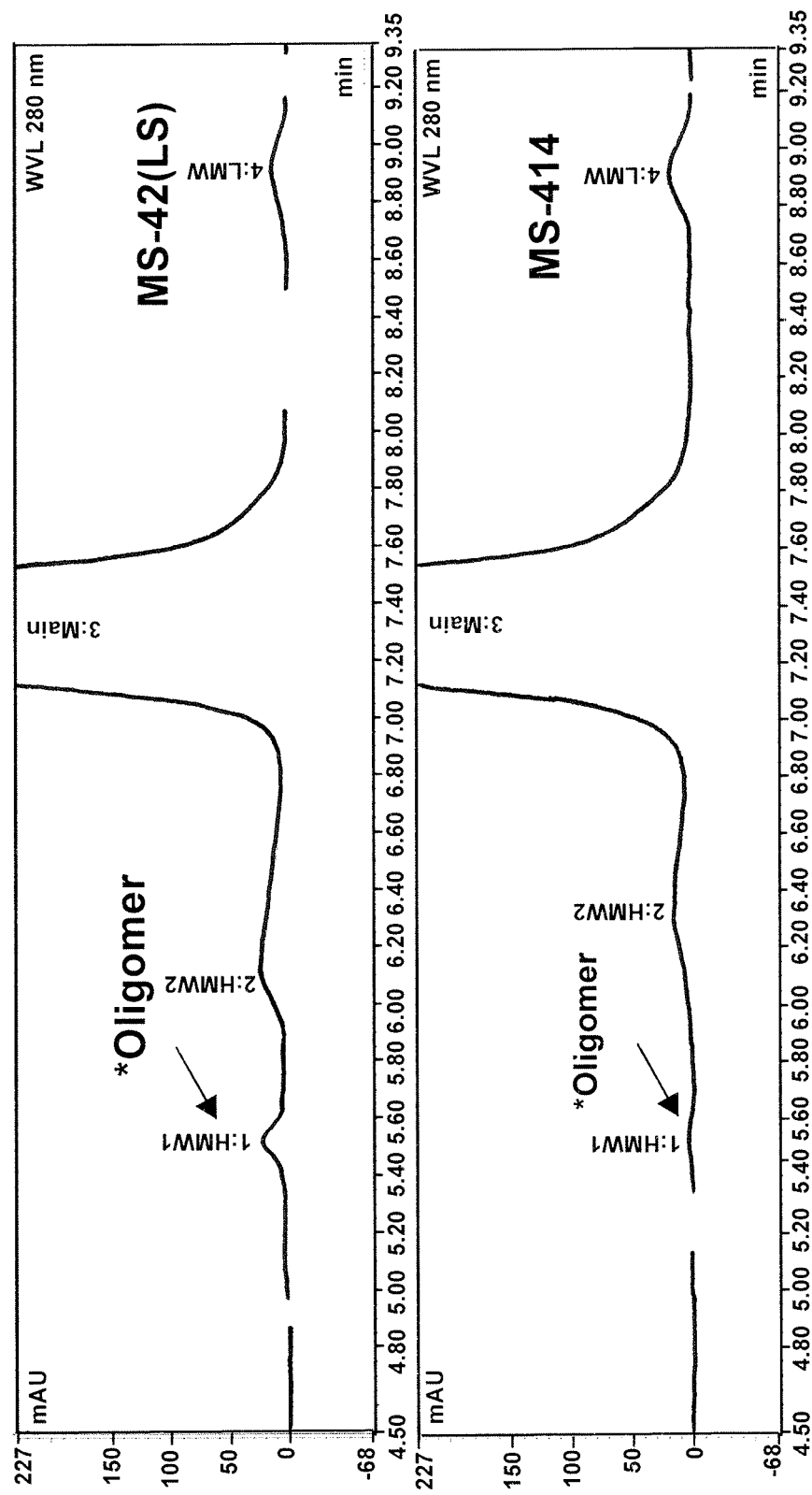
FIG. 8 is a graph showing HP-SEC chromatograms of MS-42 and MS-414 following incubation at 40° C. for 8 weeks.

The stability for each variant was assessed following buffer exchange of each molecule into a 20 mM acetate, 9% sucrose, 0.01% polysorbate 80, pH 5.2 solution followed by concentration to 100 mg/mL. A 1 mL aliquot of each solution was transferred to a 3 mL glass vial and sealed with an elastomeric stopper. Samples were stored at 40° C. At the indicated timepoints, an aliquot was removed from each vial and analyzed by HP-SEC analysis. Oligomer refers to species eluting prior to dimer peaks and main peak on the chromatogram. As evidenced by the data depicted in FIGS. 7 and 8, the percent oligomer increased by 1.4%-1.6% for the parental (MS-43) and the parental-LS (MS-42) antibodies, while the optimized molecule MS-414 showed less than 0.2% increase at 40° C. over the 8-week timeframe of incubation.

Example 6. Cell Line Development for MS-414

Materials

CHOK1 Glutamine Synthetase (GS) knockout host HD-BIOP3 (licensed from Horizon Discovery) were grown in CD OptiCHO medium (Gibco) containing glutamine before transfection with MS-414. Cells were cultured at 36.7° C. in a 5% CO2 incubator. MS-414 heavy and light chains were cloned into pD3745 expression vector.

Transfection

Transfection was done by long duration electroporation (Bodwell) using 4 mm gap cuvettes (BTX HT Electroporation System). 20E6 cells were combined with 18.75 µg of DNA and 6.25 µg of RNA transposase (ATUM Leap-In mRNA 1, MAMM stable) per cuvette. Cells were electroporated (3175 uF capacitance, 200V volts, 7250 resistance), transferred to non-selective medium and cultured for 2 days prior to selection.

Selection

Figure 9:
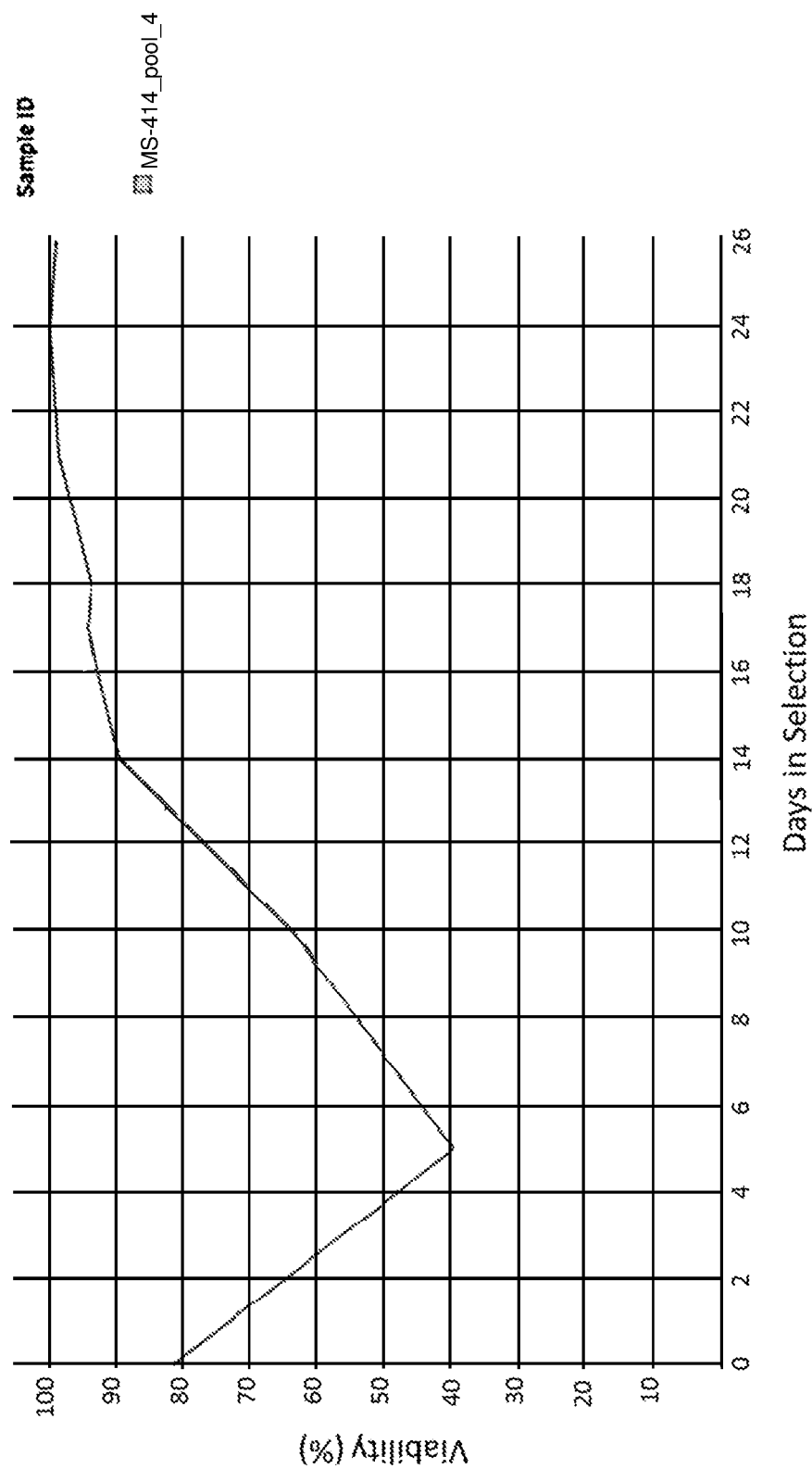
FIG. 9 is a graph showing the viability of MS-414-transfected cell pool MS-414_pool_4 during glutamine selection. The graph represents the trend of sum of viability (%) for days in selection.

CHOK1 host cells, which are deficient in glutamine synthetase (GS), were transfected with pD3745 plasmid encoding the GS gene. GS converts glutamate and ammonium into glutamine. Therefore, when glutamine is removed from the media, only those host cells that have received the GS gene would survive. Two days after transfection, the cells were placed into CD OptiCHO medium minus glutamine to select for transfected cells. The fastest recovering pools took 14 days to recover to >80% viability during glutamine selection. FIG. 9 shows the viability of pool MS-414_pool_4 that was used for cloning.

Pool Evaluation

Figure 10:
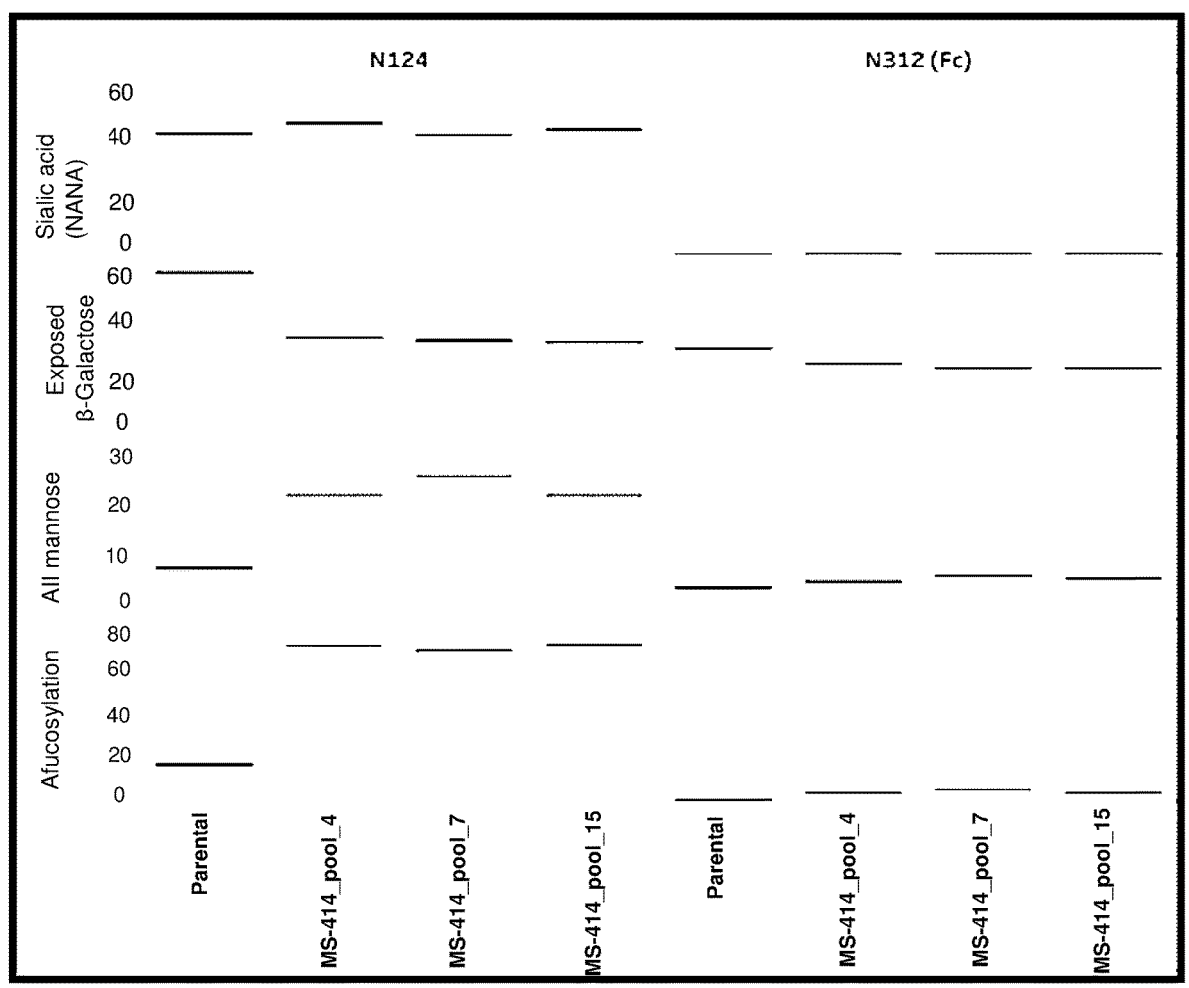
FIG. 10 is a graph showing a multi-attribute method (MAM) glycan profile of pools of MS-414-transfected cells.

Once the pools recovered to >90% viability, cells were placed into a 24 deep-well plate fed-batch production assay in 70% CD FortiCHO medium (Gibco) and 10% of each of CD Efficient Feed A, B, and C (Gibco). All pools were seeded at a set seed density of 7.5E5 cells/mL and cells were counted on days 3, 6, 7, and 8. On days 3 and 6, cells were fed 10% of the starting volume with a combination of equal amounts of CD Efficient Feeds A, B, and C. Pool MS-414_pool_4 was chosen for cloning based on quick recovery during minus glutamine selection (FIG. 9), high titer and qP (Table 14), as well as product quality (FIG. 10 and Table 15). Product quality was assessed by SE-HPLC, rCE-SDS and multi-attribute method (MAM). The MAM results from the top 3 pools showed limited variability between the pools on the two fully occupied glycosylation sites.

The purity data summarized in Table 15 indicate that the pools shared similar attributes between the various samples. MS-414_pool_4 was selected from the set of pools and cloned as it had the highest combined titer and qP.

TABLE 14

Day 8 titer and specific productivity of pool productions

| Pool | Titer (g/L) | qp (pg/c/d) |
|---|---|---|
| MS-414_pool_2 | 0.92 | 23.59 |
| MS-414_pool_3 | 0.96 | 23.5 |
| MS-414_pool_4 | 1.02 | 23.85 |
| MS-414_pool_5 | 1.03 | 23.82 |
| MS-414_pool_6 | 0.97 | 22.88 |
| MS-414_pool_7 | 1.08 | 22.43 |
| MS-414_pool_8 | 0.93 | 23.32 |
| MS-414_pool_9 | 0.99 | 24.69 |
| MS-414_pool_10 | 1.03 | 21.62 |
| MS-414_pool_11 | 1.0 | 22.04 |
| MS-414_pool_12 | 0.95 | 22.45 |
| MS-414_pool_13 | 0.93 | 23.94 |
| MS-414_pool_14 | 1.01 | 21.3 |
| MS-414_pool_15 | 0.72 | 12.49 |
| MS-414_pool_16 | 0.99 | 24.56 |

TABLE 15

Product quality summary for deep-well pool productions

| Pool | SE-UHPLC (ID #2134) | | | rCE-SDS (Beckman ID #2135) | | |
|---|---|---|---|---|---|---|
| | HMW (total) | Main | LMW | % Purity | % LMW | % Post-Peak |
| MS-414_pool_4 | 8.9 | 91.1 | 0.0 | 97.9 | 0.3 | 1.8 |
| MS-414_pool_7 | 8.6 | 91.4 | 0.0 | 97.8 | 0.4 | 1.8 |
| MS-414_pool_9 | 8.7 | 91.3 | 0.0 | 97.5 | 0.7 | 1.8 |
| MS-414_pool_13 | 8.3 | 91.7 | 0.0 | 98.3 | 0.1 | 1.6 |
| MS-414_pool_15 | 7.7 | 92.3 | 0.0 | 98.3 | 0.1 | 1.6 |
| MS-414_pool_16 | 9.0 | 91.0 | 0.0 | 97.9 | 0.3 | 1.9 |
| MS-414_pool_17 | 6.4 | 93.4 | 0.2 | 95.9 | 2.4 | 1.7 |
| MS-414_pool_18 | 8.6 | 91.3 | 0.1 | 95.2 | 3.4 | 1.4 |

Cloning

Cloning conditions and methods used for cloning of pool MS-414_pool_4 are shown in Table 16. Conditioned medium (15%) was added to the Ex-Cell CHO Cloning medium (Sigma) so that no additional growth factors were required during the cloning process. Conditioned medium was made by seeding the pool at 1E6 cells/mL; after one day, the supernatant was clarified through 0.22µ filtration. An additional pool (MS-414_pool_7) was cloned simultaneous to MS-414_pool_4 as it performed just as well as MS-414_pool_4, however, the final clone MS-414_clone_3 arose from MS-414_pool_4.

TABLE 16

Cloning condition for pool MS-414_pool_4

| | |
|---|---|
| % viability/passage | Passage 6, 94.5% viable |
| Method | Limiting dilution |
| Medium and MSX level | Sigma Ex-Cell CHO Cloning Medium + 15% conditioned medium |
| Seed density per well | 1 cell/well |
| # of plates | 40; 20 plates of MS-414_pool_4 and 20 plates of MS-414_pool_7 |
| # of single colonies transferred | 48 |
| Final clone/plate (well location) | MS-414_clone_3/P-20180410-15 (D08) |

Cloning was performed by limiting dilution at 1 cell/well. A Clone Select Imager (Molecular Devices) was used to image cells on days 0, 2, 9, 13 and 17. Cells were centrifuged at 1,130×g for 5 min to pellet the cells prior to imaging on day 0. Clonality was confirmed by examining the images on day 0 to verify that wells only contained a single cell. Clones derived from single cells were expanded to 96 deep-well plates followed by 24 deep-well plates. Two rounds of scale-up out of cloning plates were performed to capture fast and slow growing colonies. Finally, 48 clones were transferred to 24 deep-well plates and assayed under fed-batch production conditions.

Deep-Well Production Assay: Clone Screening

Figure 11:
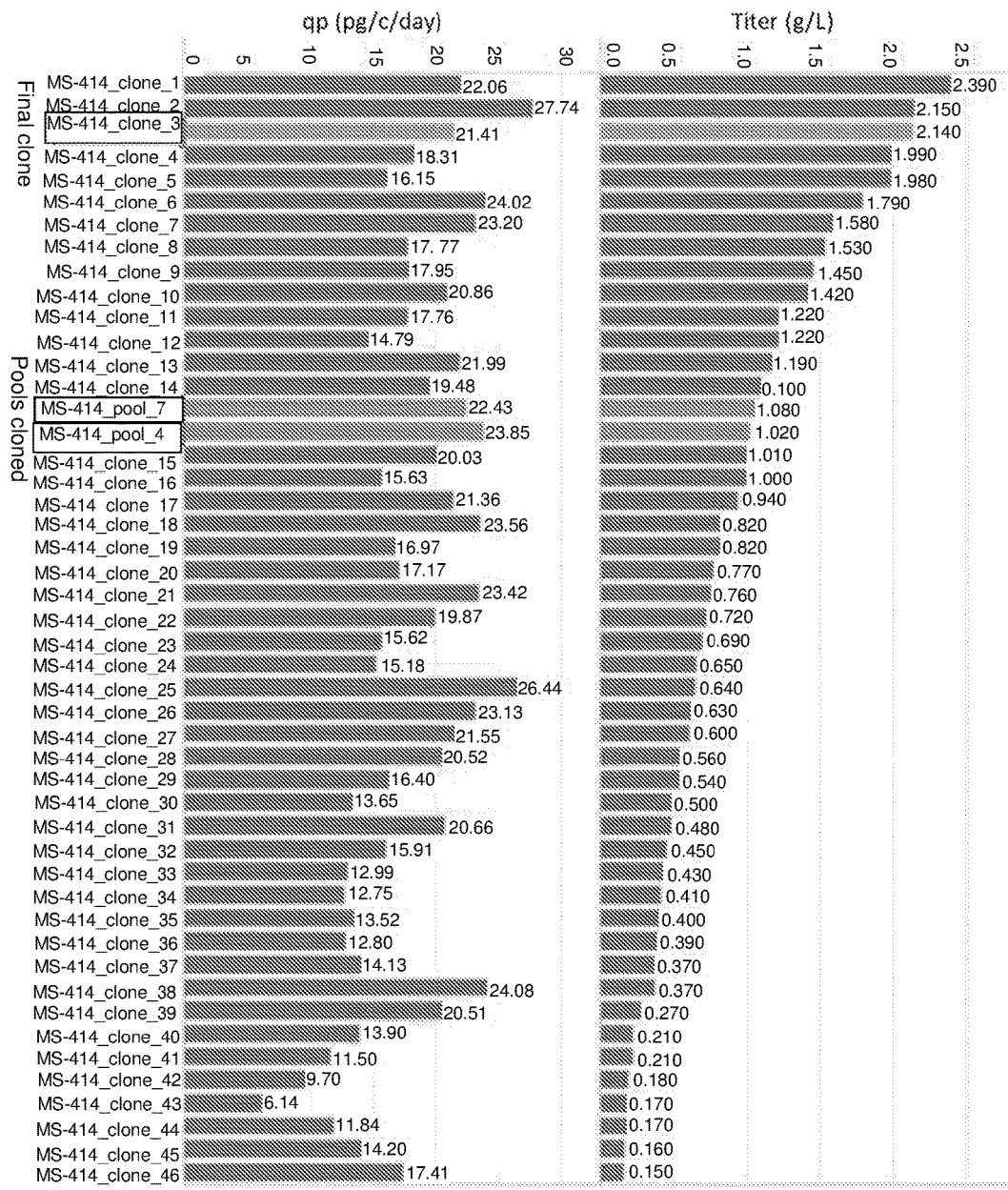
FIG. 11 is a graph showing the titer and specific productivity of clones of the MS-414-transfected cell pools MS-414_pool_4 and MS-414_pool_7.

When evaluated by the deep-well production assay, a broad level of diversity between the 48 clones was observed. A total of two production assays were conducted and a compilation of the results is shown in FIG. 11. The highest titers reached 2.39 g/L, and 29% of the clones were above the pool titers. Specific productivities ranged from 6.14 to 27.74 pg/c/day. Table 17 depicts data from the top 5 clones. The top 5 clones were 2 g/L in 8 days of production. Product quality from the top 7 clones are shown in Table 18. Overall, the product quality was consistent between the clones. The final 3 clones were selected based on a combination of product quality and deep-well production data. Once selected, the 3 clone samples were analyzed by MAM. A summary of the MAM results are shown in Table 19. Of the three clones tested by MAM, clone MS-414_clone_3 had lower levels of high mannose than the other two clones, a desirable attribute given that mAb clearance is increased by high mannose, which binds the mannose receptor.

TABLE 17

Final clones in CD Forti-CHO production

| | MS-414_clone_1 | MS-414_clone_2 | MS-414_clone_3 | MS-414_clone_4 | MS-414_clone_5 |
|---|---|---|---|---|---|
| Passage # | 6 | 6 | 6 | 6 | 6 |
| N-1 Media | CD OptiCHO | CD OptiCHO | CD OptiCHO | CD OptiCHO | CD OptiCHO |
| Production Media | CD FortiCHO | CD FortiCHO | CD FortiCHO | CD FortiCHO | CD FortiCHO |
| Seeding Density (c/mL E6) | 0.618 | 0.978 | 0.914 | 1.000 | 0.598 |
| Vessel | 24DWP | 24DWP | 24DWP | 24DWP | 24DWP |
| Feed Days | 3, 6 | 3, 6 | 3, 6 | 3, 6 | 3, 6 |
| Feed Media | 10% CDEfficient Feeds A, B, C | 10% CDEfficient Feeds A, B, C | 10% CDEfficient Feeds A, B, C | 10% CDEfficient Feeds A, B, C | 10% CDEfficient Feeds A, B, C |
| Average VCD (c/mL E6) | 14.0 | 9.7 | 12.0 | 14.0 | 15.0 |
| Ending Viability (%) | 99.8 | 98.3 | 96.5 | 84.5 | 96.9 |
| Peak VCD (c/mL E6) | 31.7 (d8) | 21.3 (d8) | 24.6 (d8) | 25.4 (d8) | 31.2 (d8) |
| Specific productivity (pg/c/day) | 22.1 | 27.7 | 21.4 | 18.3 | 16.2 |
| Titer (g/L) | 2.39 | 2.15 | 2.14 | 1.99 | 1.98 |

TABLE 18

Product quality summary of the top 7 clones

| | SE-UHPLC (ID #2225) | | | rCE-SDS (ID #2227) | | | nrCE-SDS (ID #2226) | |
|---|---|---|---|---|---|---|---|---|
| Clone ID # | % HMW (total) | % Main | % LMW | % Purity (HC + LC) | % LMW | % NG | % Post-HC | % Purity | Pre-Peaks |
| MS-414_clone_4 | 3.4 | 96.5 | 0.1 | 97.4 | 0.2 | 0.9 | 0.5 | 98.2 | 1.7 |
| MS-414_clone_8 | 2.8 | 97.1 | 0.1 | 94.9 | 0.2 | 3.2 | 0.2 | 97.8 | 2.2 |

TABLE 18-continued

Product quality summary of the top 7 clones

| Clone ID # | SE-UHPLC (ID #2225) | | | rCE-SDS (ID #2227) | | | nrCE-SDS (ID #2226) | |
|---|---|---|---|---|---|---|---|---|
| | % HMW (total) | % Main | % LMW | % Purity (HC + LC) | % LMW | % NG | % Post-HC | % Purity | % Pre-Peaks |
| MS-414_clone_3 | 3.4 | 96.5 | 0.1 | 97.2 | 0.2 | 1.1 | 0.4 | 97.8 | 2.2 |
| MS-414_clone_9 | 3.3 | 96.5 | 0.2 | 97.4 | 0.1 | 1.2 | 0.3 | 95.9 | 4.1 |
| MS-414_clone_5 | 3.1 | 96.8 | 0.1 | 97.2 | 0.2 | 1.2 | 0.5 | 97.6 | 2.2 |
| MS-414_clone_6 | 2.8 | 97.0 | 0.2 | 98.0 | 0.2 | 0.9 | 0.2 | 98.2 | 1.8 |
| MS-414_clone-_10 | 3.2 | 96.8 | 0.1 | 97.2 | 0.2 | 1.3 | 0.3 | 97.9 | 2.1 |

TABLE 19

MAM summary from top 3 clones

| Clone ID # | Glycan | Afuco | Non-Glyco. | All Fuco-sylated | Sialic Acid (NANA) | M5 | Terminal B-Galactose |
|---|---|---|---|---|---|---|---|
| MS-414_clone_4 | HV:79 | 0.0 | 99.5 | 0.5 | 0.4 | 0.0 | 0.0 |
| MS-414_clone_3 | HV:79 | 0.0 | 99.6 | 0.4 | 0.3 | 0.0 | 0.0 |
| MS-414_clone_5 | HV:79 | 0.0 | 99.6 | 0.4 | 0.4 | 0.0 | 0.0 |
| MS-414_clone_4 | HV:141 | 71.5 | 0.2 | 12.2 | 34.2 | 15.1 | 28.3 |
| MS-414_clone_3 | HV:141 | 77.1 | 0.2 | 12.2 | 28.7 | 9.8 | 34.9 |
| MS-414_clone_5 | HV:141 | 63.8 | 0.3 | 8.9 | 29.7 | 26.0 | 21.3 |
| MS-414_clone_4 | Fc-N:74 | 3.4 | 0.5 | 92.5 | 0.2 | 3.3 | 13.2 |
| MS-414_clone_3 | Fc-N:74 | 3.1 | 0.7 | 94.0 | 0.1 | 1.7 | 14.8 |
| MS-414_clone_5 | Fc-N:74 | 3.7 | 0.7 | 90.7 | 0.3 | 4.0 | 15.6 |

Three clones (MS-414_clone_3, MS-414_clone_4, and MS-414_clone_5) from the top 5 clones were chosen to run in a bioreactor IFB clone screening experiment. Clones MS-414_clone_3 and S-MS-414_clone_5 maintained high viability (>89%) throughout the duration of the IFB bioreactor run. Clone MS-414_clone_3 ultimately had the highest levels of titer, 6.5 g/L, on day 12 of production. Based on the cell culture performance of clone MS-414_clone_3 and slightly better product quality, clone MS-414_clone_3 was selected as the final clone and was used to create a master cell bank.

Example 7. Characterization of Antibody Produced from the Cell Line

Size Exclusion Ultra High Performance Liquid Chromatography (SE-UHPLC)

Size exclusion high performance liquid chromatography (SE-HPLC) analysis was performed using a WATERS™ XBRIDGE™ Protein BEH SEC 200A column. Separation was achieved under native conditions using a phosphate, sodium chloride running buffer. Peak elution was detected by UV absorbance, and the integrated purity results were reported as relative peak area percentages of the high molecular weight (HMW) component, main component (monomer), and low molecular weight (LMW) component, relative to total corrected area.

Reduced Capillary Electrophoresis—Sodium Dodecyl Sulfate (rCE-SDS)

Protein samples were denatured by heating at 70° C. for 10 min in SDS and reduced with p-mercapto-ethanol. Samples were electrokinetically injected into a 30.2 cm bare fused silica capillary filled with SDS gel buffer. An electrical voltage of −15 kV was applied across the capillary, which separates species by their difference in size. Proteins were detected using a photodiode array detector. Purity was evaluated by determining the percent peak area of each component. rCE-SDS was performed on a Beckman Coulter PA800 Plus capillary electrophoresis system. Reagent kits are available through AB Sciex LLC.

Non-Reduced Capillary Electrophoresis—Sodium Dodecyl Sulfate (nrCE-SDS)

Samples were denatured by heating at 60° C. for 5 min in the presence of SDS and N-ethylmaleimide (NEM) at low pH. The resulting negatively charged SDS-protein complex was electrokinetically injected into a 30.2 cm bare-fused silica capillary filled with SDS gel buffer. An electrical voltage of −15 kV was applied across the capillary, which separates species by their difference in size. Protein species were detected by a photodiode array (PDA) detector as they passed through the detection window. Purity was evaluated by determining the percent peak area of each component.

Multi-Attribute Method (MAM)

The samples were reduced with dithiothreitol and alkylated with iodoacetic acid. To identify the N-glycan site, samples were then either treated with PNGase F to remove the N-glycans or prepared without PNGaseF treatment to elucidate the glycan heterogeneity. Preparations were digested separately with the endopeptidases trypsin and Asp-N to ensure 100% sequence coverage. Each digest was separated by reverse phase chromatography on an Agilent ZORBAX® C18 column with an acetonitrile gradient. The eluting peptides were detected using a Q-EXACTIVE™ HF mass spectrometer. Peptides were identified with the Biopharma Finder search algorithm from Thermo Scientific. MS/MS data were required to consider a peptide/sequence confirmed.

Analysis of Protein a Purified Product

Protein A purified product from the top 3 clones (MS-414_clone_3, MS-414_clone_4, and MS-414_clone_5)

described in Example 6 was analyzed by SE-HPLC, rCE-SDS and nrCE-SDS. Results for these bioreactors are summarized in Table 20, Table 21 and Table 22. A total of six bioreactors were run in this experiment, however, only the two bioreactors from MS-414_clone_3 were harvested using the MF filter (results are depicted in the top 4 columns in each of Tables 20, 21 and 22). The remaining data in the tables are from product harvested by centrifugation. Overall, the product purity results were very similar between the various clones and showed good reproducibility between the replicate bioreactors. These results confirm that the top clones produced material of adequate quality that would be a good fit for the manufacturing process platform.

TABLE 20

Summary of SE-HPLC results from the bioreactor clone screen experiment

| Description | % Oligomer | % Dimer | % HMW (total) | % Main | % LMW |
|---|---|---|---|---|---|
| MS-414_clone_3 (R1) Bag 1 xMF | 0.3 | 3.0 | 3.4 | 96.6 | 0.04 |
| MS-414_clone_3 (R1) Bag 2 xMF | 0.4 | 3.7 | 4.2 | 95.8 | 0.04 |
| MS-414_clone_3 (R4) Bag 1 xMF | 0.5 | 3.9 | 4.4 | 95.5 | 0.11 |
| MS-414_clone_3 (R4) Bag 2 xMF | 0.8 | 5.4 | 6.2 | 93.7 | 0.11 |
| MS-414_clone_3 (R1) Bioreactor | 1.2 | 7.5 | 8.7 | 91.2 | 0.07 |
| MS-414_clone_3 (R4) Bioreactor | 1.1 | 7.6 | 8.6 | 91.3 | 0.07 |
| MS-414_clone_4 (R2) Bioreactor | 0.6 | 4.4 | 4.9 | 95.0 | 0.06 |
| MS-414_clone_4 (R3) Bioreactor | 0.4 | 3.5 | 3.9 | 96.0 | 0.11 |
| MS-414_clone_5 (R6) Bioreactor | 1.2 | 6.8 | 8.1 | 91.7 | 0.23 |
| MS-414_clone_5 (R15) Bioreactor | 1.3 | 6.8 | 8.1 | 91.7 | 0.23 |

TABLE 21

Summary of rCE-SDS results from the bioreactor clone screen experiment

| Description | % Purity | % LMW | % MMW | % NG | % Post-HCa |
|---|---|---|---|---|---|
| MS-414_clone_3 (R1) Bag 1 xMF | 93.8 | | 0.7 | 0.8 | 4.6 |
| MS-414_clone_3 (R1) Bag 2 xMF | 93.6 | | 0.7 | 0.6 | 4.9 |
| MS-414_clone_3 (R4) Bag 1 xMF | 93.5 | | 0.7 | 0.7 | 4.8 |
| MS-414_clone_3 (R4) Bag 2 xMF | 92.3 | 0.1 | 1.3 | 1.3 | 4.8 |
| MS-414_clone_3 (R1) Bioreactor | 93.4 | | 0.6 | 0.6 | 5.1 |
| MS-414_clone_3 (R4) Bioreactor | 93.5 | 0.0 | 1.0 | 0.5 | 4.9 |
| MS-414_clone_4 (R2) Bioreactor | 94.2 | 0.1 | 0.7 | 1.0 | 3.5 |
| MS-414_clone_4 (R3) Bioreactor | 93.8 | 0.1 | 1.0 | 1.2 | 3.5 |
| MS-414_clone_5 (R6) Bioreactor | 93.8 | 0.1 | 0.9 | 1.1 | 3.9 |
| MS-414_clone_5 (R15) Bioreactor | 93.5 | 0.1 | 1.2 | 1.1 | 3.8 |

TABLE 22

Summary of nrCE-SDS results from the bioreactor clone screen experiment

| Description | % Main | % Pre-Peaks | % Post-Peaks |
|---|---|---|---|
| MS-414_clone_3 (R1) Bag 1 xMF | 96.4 | 3.3 | 0.3 |
| MS-414_clone_3 (R1) Bag 2 xMF | 96.8 | 2.9 | 0.3 |
| MS-414_clone_3 (R4) Bag 1 xMF | 96.3 | 3.4 | 0.4 |
| MS-414_clone_3 (R4) Bag 2 xMF | 96.5 | 2.9 | 0.6 |
| MS-414_clone_3 (R1) Bioreactor | 96.7 | 2.9 | 0.4 |
| MS-414_clone_3 (R4) Bioreactor | 96.7 | 2.7 | 0.6 |
| MS-414_clone_4 (R2) Bioreactor | 95.2 | 4.1 | 0.7 |
| MS-414_clone_4 (R3) Bioreactor | 96.0 | 3.6 | 0.4 |
| MS-414_clone_5 (R6) Bioreactor | 94.1 | 5.3 | 0.6 |
| MS-414_clone_5 (R15) Bioreactor | 93.9 | 5.5 | 0.6 |

The two duplicate bioreactors from the top clone (MS-414_clone_3) was analyzed by MAM. A summary of the site-specific glycan results is shown in Table 23, other post-translational modifications are summarized in Table 24. MS-414 has three potential glycosylation sites, two of which are almost fully occupied. The third site located in the heavy chain variable region (HV:79), is 0.8% occupied. The various occupancy of the glycosylation sites leads to size heterogeneity detected by rCE (Post-HCa in Table 21). Both of the heavy chain variable region glycosylation sites are partially sialylated, leading to significant product charge heterogeneity. Furthermore, the Fc glycan species detected by MAM are typical for a mAb. In addition to the site-specific glycan data, MAM was used to evaluate post translation modifications (PTM) of the protein. This analysis detected typical PTMs for mAb, including low levels of deamidation and oxidation. High level of unprocessed heavy chain (HC) C-terminal lysine, which further contributes to molecule charge heterogeneity and complexity, were detected by this analysis.

TABLE 23

Summary of MAM glycan result for clone MS-414_clone_3 (duplicate bioreactors)

| MS-414_clone_3 Bioreactor # | Glycan Position | Afuco. | Non-Glyco. | All Fucosylated | Sialic Acid (NANA) | M5 | Terminal B-Galactose |
|---|---|---|---|---|---|---|---|
| Reactor 1 | HV:79 | 0.0 | 99.2 | 0.8 | 0.7 | 0.0 | 0.1 |
| Reactor 2 | HV:79 | 0.0 | 99.2 | 0.8 | 0.7 | 0.0 | 0.1 |
| Reactor 1 | HV:141 | 80.1 | 0.4 | 12.8 | 52.4 | 5.8 | 37.3 |
| Reactor 2 | HV:141 | 79.7 | 0.5 | 13.8 | 52.5 | 5.0 | 37.9 |
| Reactor 1 | Fc-N:74 | 6.3 | 0.5 | 91.8 | 0.4 | 1.2 | 46.9 |
| Reactor 2 | Fc-N:74 | 5.6 | 0.5 | 92.2 | 0.4 | 1.2 | 49.2 |

TABLE 24

Summary of MAM PTM result for clone MS-414_clone_3 (duplicate bioreactors)

| Sample | Fc-C:51 Deamidation | Fc-N:22 Oxidation | HC C-Term. Lysine |
|---|---|---|---|
| Reactor 1 | 0.3 | 1.3 | 18.8 |
| Reactor 4 | 0.4 | 1.5 | 20.0 |

Example 8. Pharmacokinetic Characterization of PGT121 Variant Antibodies

Background

Pharmacokinetic (PK) characterization of optimized PGT121 monoclonal antibody variants was performed using FcRn Tg276 mice. Mice were randomized into 4 groups with 4 mice per group, and infused once with 10 mg/kg PGT121 monoclonal antibody variant with blood samples collected through 28 days (e.g., through about 1-23 hours or 1-28 days) following infusion, as per the schedule outlined in Table 25.

TABLE 25

Pharmacokinetic experiment scheme

| Group | N | Dose | Monoclonal Variant description | Blood sample schedule |
|---|---|---|---|---|
| MS-43 | 4 | 10 mg/kg | PGT121 Parental | 1h, 8h, 1d, 2d, 5d, 7d, 10d, 14d, 21d, 28d |
| MS-42 | 4 | 10 mg/kg | PGT121-LS | 1h, 8h, 1d, 2d, 5d, 7d, 10d, 14d, 21d, 28d |
| MS-414 | 4 | 10 mg/kg | Optimized PGT121-LS | 1h, 8h, 1d, 2d, 5d, 7d, 10d, 14d, 21d, 28d |
| MS-444 | 4 | 10 mg/kg | Optimized PGT121-LS (minus HC Fab glycan) | 1h, 8h, 1d, 2d, 5d, 7d, 10d, 14d, 21d, 28d |

Objective

Compare half-life of optimized antibodies with the parental (non-LS) to ensure that the residue changes did not affect the functioning of the LS mutation.

Endpoints

Binding antibody concentrations of PGT121 variants were measured at time points shown in Table 25. The lower limit of quantification (LLOQ) was 1 pg/mL and concentrations were considered censored below this level. If an animal had a concentration measured above the lower limit after the lower limit was previously reached, then that measurement was also considered censored.

Methods

Serum HIV-1 IgG against Con S gp140 was measured on a Bio-Plex instrument (Bio-Rad) using a standardized custom HIV-1 Luminex assay (Tomaras et al., *J Virol* 82: 12449-12463, 2008; Haynes et al., *N Engl J Med* 366: 1275-1286, 2012; Yates et al., *Nat Muc Immunol* 6: 692-703, 2013; Tomaras et al., *PLoS ONE* 110: 9019-9024, 2013; hereby incorporated by reference in their entirety). The readout was concentration interpolated from standard curves with each infused mAb variant. Negative controls included a plate level control (i.e., a blank well run on each plate) and blank (uncoupled) beads. The positive control in each assay was polyclonal IgG from HIV-positive participants (HIVIG). Several criteria were used to determine if data from an assay were acceptable and could be statistically analyzed. If the blank bead negative control exceeded 5,000 MF, the sample was repeated, and if it exceeded 5,000 MF, the sample was excluded from analysis due to high background. The LLOQ for PGT121 concentration was 1 μg/ml.

Statistics

PK Models

Clearance from the central compartment (CL), volume of the central compartment (Vc), inter-compartmental distribution clearance (Q), and volume of the peripheral compartment (Vp) were computed $$k_{10} = \frac{CL}{V_c}$$

$$k_{12} = \frac{Q}{V_c}$$

$$k_{21} = \frac{Q}{V_p},$$

using two-compartmental models in NONMEM 7.4.2. NONMEM is a model analysis program that performs nonlinear d effects modeling for PK analysis. Rate parameters were parameterized from the PK parameters as follows:

Distribution and elimination half-lives were computed, respectively, as follows:
1

$$t_{\frac{1}{2},\alpha} = \frac{\log(2)}{\alpha}$$

$$t_{\frac{1}{2},\beta} = \frac{\log(2)}{\beta}$$

such that $\alpha$ describes the distribution phase and $\beta$ describes the elimination phase, where $$B = k_{12} + k_{21} + k_{10}$$

$$C = k_{21} \times k_{10}$$

$$\alpha = \frac{-B + \sqrt{B^2 - 4C}}{2}$$

$$\beta = \frac{-B + \sqrt{B^2 - 4C}}{2}$$

Three PK models were fit to these data in the following order:

Model 1. A population (non-linear mixed effects) PK model parameterized as described above fit to data from each group separately. Individual-level parameter estimates and predicted values were then extracted from the population-level estimates. All values after the first concentration below the LLOQ were treated as censored and incorporated into the likelihood for estimation (Beal, *J Pharmacokinet Pharmacodyn* 28: 481-504, 2001; Mould and Upton, *CPT: Pharmacometrics & Systems Pharmacology* 1 (9), 2012; hereby incorporated by reference in its entirety).

Model 2. Based on results from Model 1 identifying an increased elimination rate (potentially anti-drug activity (ADA)), two-compartment PK models were fit with time-dependent elimination rates to each animal's concentration data. In these models, $k_{10}$, the rate of elimination from the central compartment, was modified as follows:

$$k_{10}(t) = \begin{cases} k_0 & \text{if } t \le T_0 \\ k_0 + k_1 * (t - T_0) & \text{if } t > T_0 \end{cases}$$

with $k_1$ as additional optimized parameters to represent a potential increase in the rate of antibody elimination in response to ADA. Specifically, the $k_0$ parameter represents the constant elimination rate prior to ADA onset or if no ADA was present, $T_0$ represents the onset time of ADA modification, and $k_1$ is the slope of the clearance rate change per time after $T_0$ modifying the constant $k_0$ rate. A positive $k_1$ represents an increasing clearance rate after $T_0$ and a negative $k_1$ represents slowing clearance after $T_0$. Model 1 and Model 2 are equivalent if either $k_1=0$ or $T_0$ is not estimated to occur during the observation period.

Model 3. Using the results from Model 2, a population PK model for each group was fit using concentration up to time, T0, under the assumption that the half-life estimated is a valid estimate of elimination half-life in the absence of a third elimination phase potentially unique to the animal model. Individual-level parameter estimates and predicted values were then extracted from the population-level estimates.

Graphical and Descriptive Analysis

Half-lives distributions were plotted as box plots. The mid-line of the box denotes the median and the ends of the box denote the 25th and 75th percentiles. Individual estimates are denoted by points. The whiskers denote the most extreme data points that are no more than 1.5 times the interquartile range (i.e., height of the box).

Concentrations and predicted concentration curves were plotted as line plots with the raw data presented as point to demonstrate fit. Medians and ranges were calculated to present estimated parameters including half-lives. Group comparisons of half-lives between groups was done descriptively.

Animal Cohort

A total of 16 mice were infused with PGT121 variants (4 per group) with concentrations measured at all scheduled time points following infusion (Table 25). No missing data were observed.

Results

PK Models

Figure 12:
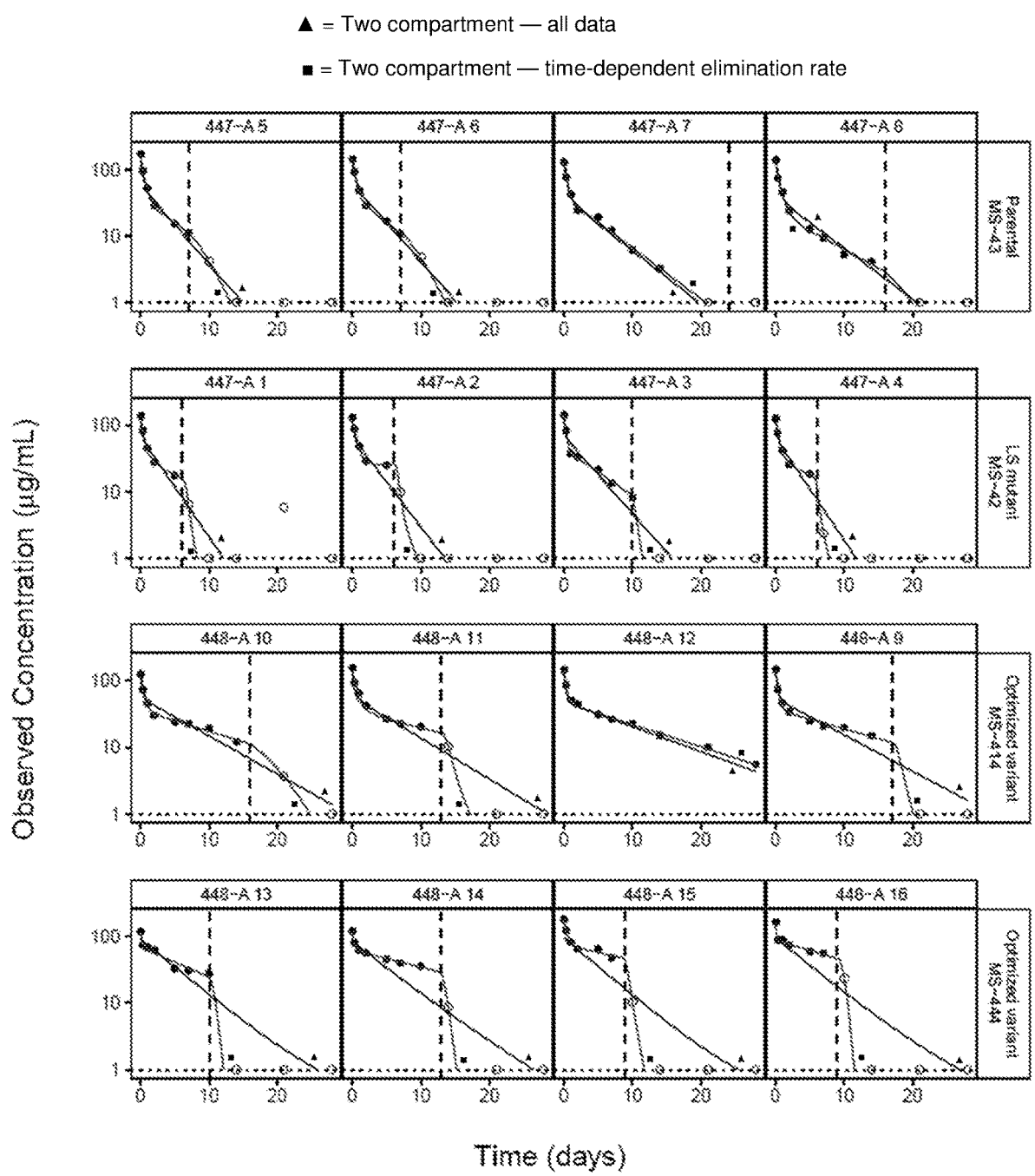
FIG. 12 is a graph showing estimated concentration curves by animal (A 1 through A 16) using two PK model approaches: (1) A group-level two compartment population model using all concentration data; and (2) a two-compartment model with time-dependent elimination rate fit to individual animals. Each individual animal is denoted by a unique animal identifier number that is shown in the headers of the graph. Points denote observed data and solid lines denote estimated concentration curves (individual-level predictions were calculated from the population models). Horizontal dotted lines denote the lower limit of quantification (1 µg/mL). Deviation between models indicates misspecification in the two-compartment model using the full dataset.

All PGT121 variants exhibited deviation from the standard two-compartment PK model as demonstrated by the onset of increasing elimination rates with timing potentially depending on the variant (FIG. 12). Additional models were fit to each individual animal with additional parameters to estimate the onset of the third phase, which tended to occur earliest in the -LS variant (MS-42) (6-10 days) (Table 26). Only one animal (infused with MS-414) showed no sign of an ADA response. Due to limited measurements taken after the onset of ADA and the complexity of the dynamics, elimination half-lives for the models fit to the ADA data were neither estimated nor compared.

Figure 13:
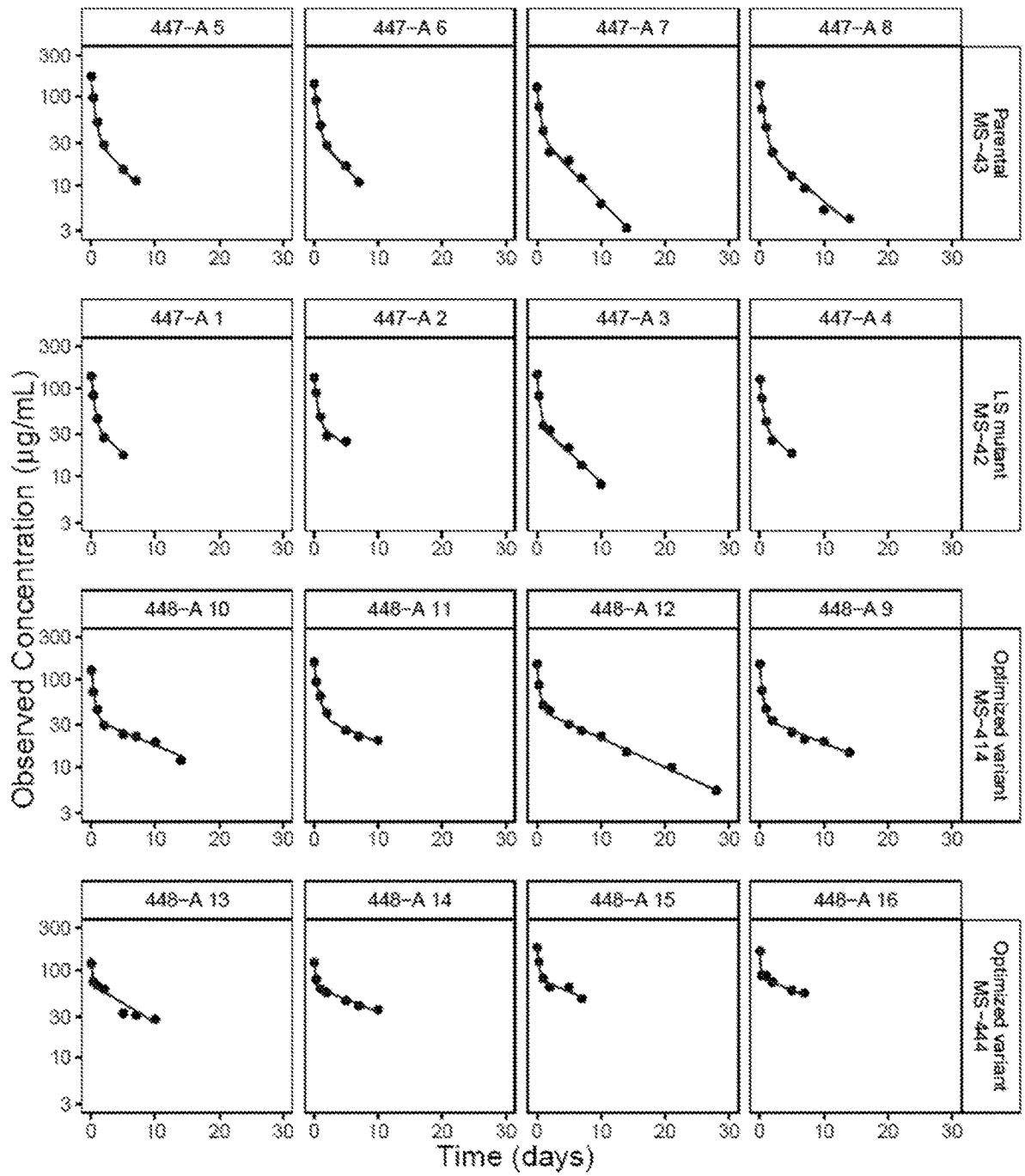
FIG. 13 is a graph showing estimated concentration curves by animal (A 1 through A 16) using two-compartment population PK models for each antibody group. Each individual animal is denoted by a unique animal identifier number that is shown in the headers of the graph. Models were estimated using data through the estimated time of increased clearance rate for calculating elimination half-lives. Points denote observed data used in the model and the lines denote concentration curves estimated using individual-level parameter estimates from the population models.

Assuming that the increased clearance rate was an ADA response and was the result of the animal model, population two-compartment PK models for each group were also estimated until the estimated onset time of the increased clearance (FIG. 13). Assessment of the PK parameters showed similar estimates for both the volume of the central compartment ($V_c$) and peripheral compartment ($V_p$) (Table 27). The ranges of central compartment estimates were also similar to those estimated in the ADA model (Table 26). Inter-compartmental distribution clearance (Q) was generally higher in MS-444 compared to the other variants (with a smaller $V_p$) potentially indicating a faster distributional phase. The clearance rate of the central compartment (CL) was slower in the optimized variants compared to the parental or LS-mutant.

TABLE 26

Estimated parameters from the two-compartment PK model with time-dependent elimination rates fit to each animal's concentration data (Model 2). Estimated ADA onset time (T0, bolded) used to subset data for the final PK models.

| PGT121 variant | Animal ID | T0 (Days) | Vc | k21 | k12 | k0 | k1 |
|---|---|---|---|---|---|---|---|
| Parental MS-43 | 447-A 5 | 7 | 1.317 | 0.587 | 1.003 | 0.593 | 0.27 |
| | 447-A 6 | 7 | 1.649 | 0.692 | 1.009 | 0.531 | 0.2 |
| | 447-A 7 | 2 | 1.731 | 0.934 | 1.418 | 0.508 | 0.10 |
| | 447-A 8 | 16 | 1.941 | 0.384 | 0.746 | 0.508 | 0.171 |
| | Median | 11.50 | 1.69 | 0.64 | 1.01 | 0.52 | 0.19 |
| | (range) | (7-24) | (1.32-1.94) | (0.38-0.93) | (0.75-1.42) | (0.51-0.59) | (0.11-0.27) |
| LS mutant MS-42 | 447-A 1 | 6 | 1.72 | 0.63 | 1.136 | 0.4 | 4.657 |
| | 447-A 2 | 6 | 1.711 | 0.31 | 1.331 | 0 | 4.735 |
| | 447-A 3 | 1 | 1.572 | 1.19 | 2.075 | 0. | 4.042 |
| | 447-A 4 | 6 | 1.805 | 0.536 | 1.198 | 0.344 | 4.718 |
| | Median | 6.00 | 1.72 | 0.58 | 1.26 | 0.39 | 4.69 |
| | (range) | (6-10) | (1.57-1.81) | (0.31-1.19) | (1.14-2.08) | (0-0.49) | (4.04-4.73) |
| Optimized variant MS-414 | 448-A 9 | 17 | 1.565 | 0.766 | 1.793 | 0.239 | 2.28 |
| | 448-A 10 | 16 | 1.844 | 0.762 | 1.494 | 0.231 | 0.14 |
| | 448-A 11 | 13 | 1.478 | 0.39 | 0.813 | 0.213 | 1.32 |
| | 448-A 12 | 37 | 1.38 | 1.004 | 1.794 | 0.226 | 1.722 |
| | Median | 16.50 | 1.52 | 0.76 | 1.64 | 0.23 | 1.52 |
| | (range) | (13-37) | (1.38-1.84) | (0.39-1) | (0.81-1.79) | (0.21-0.24) | (0.14-2.28) |
| Optimized variant MS-444 | 448-A 13 | 10 | 2.024 | 2.267 | 1.461 | 0.172 | 2.53 |
| | 448-A 14 | 13 | 1.758 | 2.126 | 1.891 | 0.115 | 2.601 |
| | 448-A 15 | 9 | 1.323 | 1.081 | 1.395 | 0.13 | 3.076 |

TABLE 26-continued

Estimated parameters from the two-compartment PK model with time-dependent elimination rates fit to each animal's concentration data (Model 2). Estimated ADA onset time (T0, bolded) used to subset data for the final PK models.

| PGT121 variant | Animal ID | T0 (Days) | Vc | k21 | k12 | k0 | k1 |
|---|---|---|---|---|---|---|---|
| | 448-A 16 | 9 | 1.476 | 5.468 | 4.688 | 0.133 | 2.922 |
| | Median | 9.50 | 1.62 | 2.20 | 1.68 | 0.13 | 2.76 |
| | (range) | (9-13) | (1.32-2.02) | (1.08-5.47) | (1.39-4.69) | (0.11-0.17) | (2.53-3.08) |

TABLE 27

Individual-level PK parameters derived from the estimated two-compartment population models or each PGT121 variant. Estimated ADA onset time (T0, bolded) was estimated separately (Model 2) and determined data input for these PK models.

| PGT121 variant | Animal ID | Vc | CL | Q | Vp | T0 (days) |
|---|---|---|---|---|---|---|
| Parental MS-43 | 447-A 5 | 1.354 | 0.813 | 1.426 | 2.289 | 7 |
| | 447-A 6 | 1.549 | 0.854 | 1.573 | 2.535 | 7 |
| | 447-A 7 | 1.6 | 0.85 | 1.87 | 2.512 | 24 |
| | 447-A 8 | 1.646 | 0.922 | 1.425 | 3.353 | 16 |
| | Median | 1.57 | 0.85 | 1.50 | 2.52 | 11.50 |
| | (range) | (1.35-1.65) | (0.81-0.92) | (1.42-1.87) | (2.29-3.35) | (7-24) |
| LS mutant MS-42 | 447-A 1 | 1.561 | 0.79 | 2.266 | 2.744 | 6 |
| | 447-A 2 | 1.561 | 0.602 | 2.267 | 2.744 | 6 |
| | 447-A 3 | 1.559 | 0.755 | 2.27 | 2.744 | 10 |
| | 447-A 4 | 1.564 | 0.776 | 2.267 | 2.744 | 6 |
| | Median | 1.56 | 0.77 | 2.27 | 2.74 | 6.00 |
| | (range) | (1.56-1.56) | (0.6-0.79) | (2.27-2.27) | (2.74-2.74) | (6-10) |
| Optimized variant MS-414 | 448-A 10 | 1.573 | 0.403 | 2.527 | 3.785 | 16 |
| | 448-A 11 | 1.399 | 0.338 | 1.312 | 2.88 | 13 |
| | 448-A 12 | 1.365 | 0.314 | 2.144 | 2.537 | 37 |
| | 448-A 9 | 1.455 | 0.366 | 2.4 | 3.658 | 17 |
| | Median | 1.43 | 0.35 | 2.27 | 3.27 | 16.50 |
| | (range) | (1.37-1.57) | (0.31-0.4) | (1.31-2.53) | (2.54-3.79) | (13-37) |
| Optimized variant MS-444 | 448-A 13 | 1.694 | 0.335 | 4.812 | 1.576 | 10 |
| | 448-A 14 | 1.59 | 0.216 | 3.7 | 1.576 | 13 |
| | 448-A 15 | 1.254 | 0.199 | 2.198 | 1.576 | 9 |
| | 448-A 16 | 1.276 | 0.189 | 4.981 | 1.576 | 9 |
| | Median | 1.43 | 0.21 | 4.26 | 1.58 | 9.50 |
| | (range) | (1.25-1.69) | (0.19-0.33) | (2.2-4.98) | (1.58-1.58) | (9-13) |

Elimination Half-Lives

Figure 14:
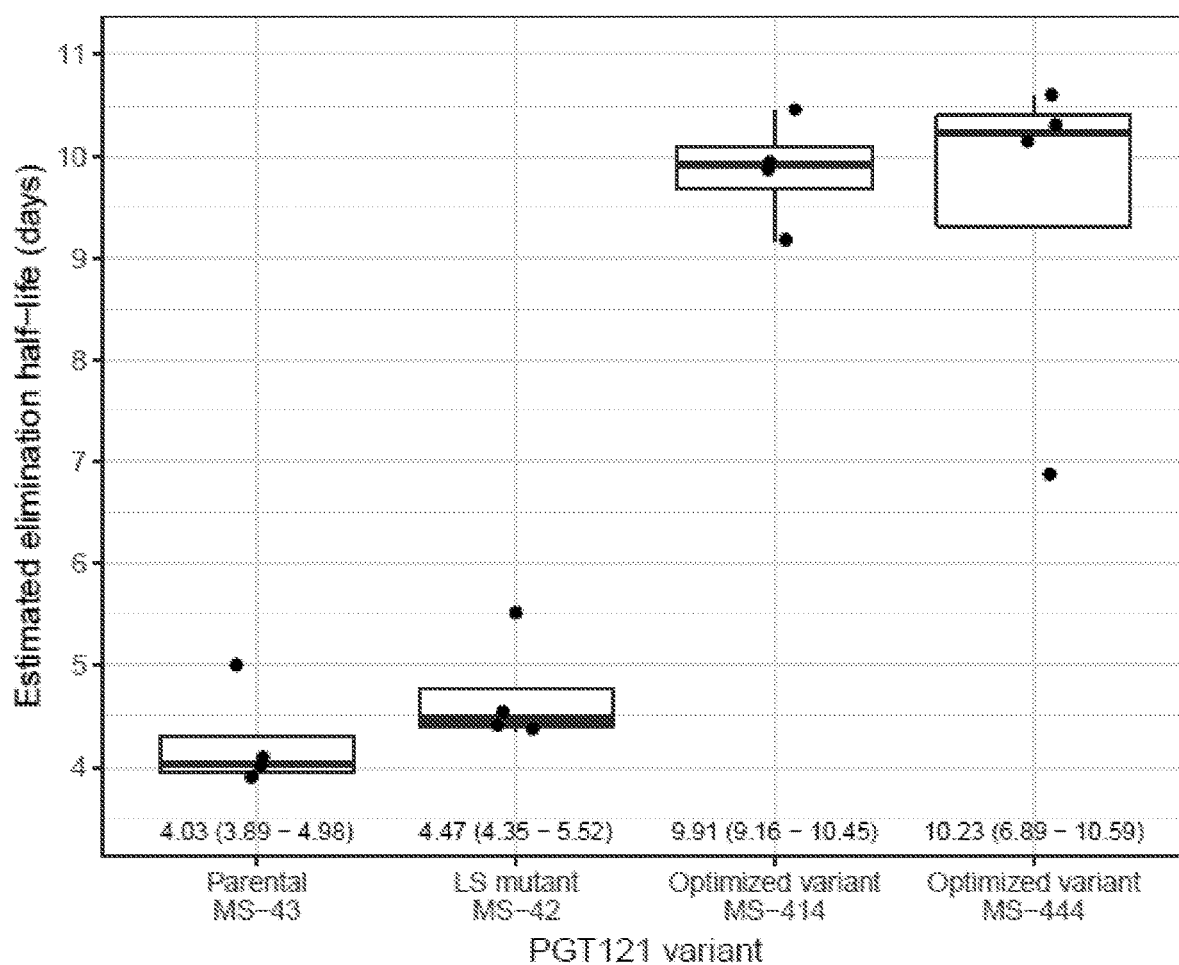
FIG. 14 is a graph showing estimated half-life (days) distributions by antibody variant group plotted as box plots. Individual estimates are denoted by points. Medians and ranges for each group are displayed at the bottom of the plot. Half-lives were estimated using two-compartment population PK models for each group incorporating concentration data until estimated onset of increased elimination.

ADA-adjusted elimination half-lives were calculated for each animal using antibody concentration kinetics measured prior to the onset of the increased clearance as estimated by the ADA-models (Table 28 and FIG. 14). The longest half-lives were observed in the optimized strains, MS-414 and MS-444, with similar medians (9.91 and 10.23 days, respectively). All estimated half-lives from the optimized strains were longer than the LS variant, MS-42 (median: 4.5; range: 4.4-5.5 days), which had slightly longer half-lives than the parental strain, MS-43 (median: 4; range: 3.9-5 days).

TABLE 28

Estimated half-lives (days) for each PGT121 variant

| PGT121 variant | N | Half-life median (range) (days) |
|---|---|---|
| Parental MS-43 | 4 | 4.03 (3.89-4.98) |
| LS mutant MS-42 | 4 | 4.47 (4.35-5.52) |
| Optimized variant MS-414 | 4 | 9.91 (9.16-10.45) |
| Optimized variant MS-444 | 4 | 10.23 (6.89-10.59) |

Summary

PK analyses of PGT121 monoclonal antibody infused into mice revealed deviation from the standard two-compartment model of antibody clearance. There was evidence of increased clearance rate potentially due to ADA in the animal model. In our initial analysis, incorporating all of the antibody concentration data, we fit two-compartment models with and without time-dependent elimination rate to demonstrate the potential existence of ADA during the study (FIG. 12) and to estimate PK parameters in the absence of ADA. The onset of ADA was estimated to occur as early as 6 days post infusion. The onset time and magnitude of the ADA effect may depend on the variant (Tables 26 and 27).

To estimate elimination half-life absent of ADA, we fit two-compartment population PK models of antibody concentration kinetics using data until the estimated onset of ADA (FIG. 13). In the ADA-adjusted analysis, the longest half-lives were observed in the optimized strains MS-414 (median: 9.9; range: 9.2-10.4 days) and MS-444 (median: 10.2; range: 6.9-10.6 days), which were uniformly longer than the LS mutant, MS-42, (median: 4.5; range: 4.4-5.5 days) and then the parental strain, MS-43 (median: 4; range: 3.9-5 days) (Table 28 and FIG. 14).

Other Embodiments

While the invention has been described in connection with specific embodiments thereof, it will be understood that it is capable of further modifications and this application is intended to cover any variations, uses, or adaptations of the

SEQUENCE LISTING (1407 sequences)

SEQ ID NO: 1 - DNA, 693 bp, Homo sapiens
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 2 - protein, 230 aa, Homo sapiens
MMSFVSLLLVGILFHATQASDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3 - DNA, 33 bp, Homo sapiens
ggggaaaagagccttggaagtagagctgtacaa

SEQ ID NO: 4 - protein, 11 aa, Homo sapiens
GEKSLGSRAVQ

SEQ ID NO: 5 - DNA, 21 bp, Homo sapiens
aataatcaggaccggccctca

SEQ ID NO: 6 - protein, 7 aa, Homo sapiens
NNQDRPS

SEQ ID NO: 7 - DNA, 36 bp, Homo sapiens
catatatgggatagtagagttcccaccaaatgggtc

SEQ ID NO: 8 - protein, 12 aa, Homo sapiens
HIWDSRVPTKWV

SEQ ID NO: 9 - DNA, 1446 bp, Homo sapiens
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctaggtggcagcaggggaacgtcttctcatgctccgtgatgcatgaggctctgcacaaccactacacgcagaagagcctctccctgtctccgggtaaatga

SEQ ID NO: 10 - protein, 481 aa, Homo sapiens
MMSFVSLLLVGILFHATQAQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - DNA, 18 bp, Homo sapiens
agtgacagttactggagc

SEQ ID NO: 12 - protein, 6 aa, Homo sapiens
SDSYWS

SEQ ID NO: 13 - DNA, 48 bp, Homo sapiens
tatgtccacaaaagcggcgacacaaattacagcccctccctcaagagt

SEQ ID NO: 14 - protein, 16 aa, Homo sapiens
YVHKSGDTNYSPSLKS

SEQ ID NO: 15 - DNA, 72 bp, Homo sapiens
acactgcacgggaggagaatttatggaatcgttgccttcaatgagtggttcacctacttctacatggacgtc

SEQ ID NO: 16 - protein, 24 aa, Homo sapiens
TLHGRRIYGIVAFNEWFTYFYMDV

SEQ ID NO: 17 - DNA, 693 bp, Artificial Sequence
  Synthetic Construct
atgatgtcctttgtctctctgctcctggttggcatcctattccatgccacccaggcccccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 18 - protein, 230 aa, Artificial Sequence
  Synthetic Construct
MMSFVSLLLVGILFHATQAPDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 19 - DNA, 33 bp, Artificial Sequence; identical to SEQ ID NO: 3
  Synthetic Construct

SEQ ID NO: 20 - protein, 11 aa, Artificial Sequence
  Synthetic Construct
GEKSLGSRAVQ

SEQ ID NO: 21 - DNA, 21 bp, Artificial Sequence
  Synthetic Construct
aataatcaggaccggccctca

SEQ ID NO: 22 - protein, 7 aa, Artificial Sequence
  Synthetic Construct
NNQDRPS

SEQ ID NO: 23 - DNA, 36 bp, Artificial Sequence; identical to SEQ ID NO: 7
  Synthetic Construct

SEQ ID NO: 24 - protein, 12 aa, Artificial Sequence
  Synthetic Construct
HIWDSRVPTKWV

SEQ ID NO: 25 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 26 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 27 - DNA, 18 bp, Artificial Sequence
  Synthetic Construct
agtgacagttactggagc

SEQ ID NO: 28 - protein, 6 aa, Artificial Sequence
  Synthetic Construct
SDSYWS

SEQ ID NO: 29 - DNA, 48 bp, Artificial Sequence; identical to SEQ ID NO: 13
  Synthetic Construct

SEQ ID NO: 30 - protein, 16 aa, Artificial Sequence
  Synthetic Construct
YVHKSGDTNYSPSLKS

SEQ ID NO: 31 - DNA, 72 bp, Artificial Sequence; identical to SEQ ID NO: 15
  Synthetic Construct

SEQ ID NO: 32 - protein, 24 aa, Artificial Sequence
  Synthetic Construct
TLHGRRIYGIVAFNEWFTYFYMDV

SEQ ID NO: 33 - DNA, 693 bp, Artificial Sequence
  Synthetic Construct
atgatgtcctttgtctctctgctcctggttggcatcctattccatgccacccaggcctcctccatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 34 - protein, 230 aa, Artificial Sequence
  Synthetic Construct
MMSFVSLLLVGILFHATQASSISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 35 - DNA, 33 bp, Artificial Sequence; identical to SEQ ID NO: 3
  Synthetic Construct

SEQ ID NO: 36 - protein, 11 aa, Artificial Sequence
  Synthetic Construct
GEKSLGSRAVQ

SEQ ID NO: 37 - DNA, 21 bp, Artificial Sequence
  Synthetic Construct
aataatcaggaccggccctca

SEQ ID NO: 38 - protein, 7 aa, Artificial Sequence
  Synthetic Construct
NNQDRPS

SEQ ID NO: 39 - DNA, 36 bp, Artificial Sequence; identical to SEQ ID NO: 7
  Synthetic Construct

SEQ ID NO: 40 - protein, 12 aa, Artificial Sequence
  Synthetic Construct
HIWDSRVPTKWV

SEQ ID NO: 41 - DNA, 1446 bp, Artificial Sequence; identical to SEQ ID NO: 25
  Synthetic Construct

SEQ ID NO: 42 - protein, 481 aa, Artificial Sequence; identical to SEQ ID NO: 26
  Synthetic Construct

SEQ ID NO: 43 - DNA, 18 bp, Artificial Sequence
  Synthetic Construct
agtgacagttactggagc

SEQ ID NO: 44 - protein, 6 aa, Artificial Sequence
  Synthetic Construct
SDSYWS

SEQ ID NO: 45 - DNA, 48 bp, Artificial Sequence; identical to SEQ ID NO: 13
  Synthetic Construct

SEQ ID NO: 46 - protein, 16 aa, Artificial Sequence
  Synthetic Construct
YVHKSGDTNYSPSLKS

SEQ ID NO: 47 - DNA, 72 bp, Artificial Sequence; identical to SEQ ID NO: 15
  Synthetic Construct

SEQ ID NO: 48 - protein, 24 aa, Artificial Sequence
  Synthetic Construct
TLHGRRIYGIVAFNEWFTYFYMDV

SEQ ID NO: 49 - DNA, 693 bp, Artificial Sequence
  Synthetic Construct
atgatgtcctttgtctctctgctcctggttggcatcctattccatgccacccaggcctccgatatatctgtggccccaggacagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 50 - protein, 230 aa, Artificial Sequence
  Synthetic Construct
MMSFVSLLLVGILFHATQASDISVAPGQTARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 51 - DNA, 33 bp, Artificial Sequence; identical to SEQ ID NO: 3
  Synthetic Construct

SEQ ID NO: 52 - protein, 11 aa, Artificial Sequence
  Synthetic Construct
GEKSLGSRAVQ

SEQ ID NO: 53 - DNA, 21 bp, Artificial Sequence
  Synthetic Construct
aataatcaggaccggccctca

SEQ ID NO: 54 - protein, 7 aa, Artificial Sequence
  Synthetic Construct
NNQDRPS

SEQ ID NO: 55 - DNA, 36 bp, Artificial Sequence; identical to SEQ ID NO: 7
  Synthetic Construct

SEQ ID NO: 56 - protein, 12 aa, Artificial Sequence
  Synthetic Construct
HIWDSRVPTKWV

SEQ ID NO: 57 - DNA, 1446 bp, Artificial Sequence; identical to SEQ ID NO: 25
  Synthetic Construct

SEQ ID NO: 58 - protein, 481 aa, Artificial Sequence; identical to SEQ ID NO: 26
  Synthetic Construct

SEQ ID NO: 59 - DNA, 18 bp, Artificial Sequence
  Synthetic Construct
agtgacagttactggagc

SEQ ID NO: 60 - protein, 6 aa, Artificial Sequence
  Synthetic Construct
SDSYWS

SEQ ID NO: 61 - DNA, 48 bp, Artificial Sequence; identical to SEQ ID NO: 13
  Synthetic Construct

SEQ ID NO: 62 - protein, 16 aa, Artificial Sequence
  Synthetic Construct
YVHKSGDTNYSPSLKS

SEQ ID NO: 63 - DNA, 72 bp, Artificial Sequence; identical to SEQ ID NO: 15
  Synthetic Construct

SEQ ID NO: 64 - protein, 24 aa, Artificial Sequence
  Synthetic Construct
TLHGRRIYGIVAFNEWFTYFYMDV

SEQ ID NO: 65 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacagagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 66 - protein, 230 aa, Artificial Sequence
  Synthetic Construct
MMSFVSLLLVGILFHATQASDISVAPGETARISCGEKSLGSRAVQWYQQRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 67 - DNA, 33 bp, Artificial Sequence; identical to SEQ ID NO: 3
  Synthetic Construct

SEQ ID NO: 68 - protein, 11 aa, Artificial Sequence
  Synthetic Construct
GEKSLGSRAVQ

SEQ ID NO: 69 - DNA, 21 bp, Artificial Sequence
  Synthetic Construct
aataatcaggaccggccctca

SEQ ID NO: 70 - protein, 7 aa, Artificial Sequence
  Synthetic Construct
NNQDRPS

SEQ ID NO: 71 - DNA, 36 bp, Artificial Sequence; identical to SEQ ID NO: 7
  Synthetic Construct

SEQ ID NO: 72 - protein, 12 aa, Artificial Sequence
  Synthetic Construct
HIWDSRVPTKWV

SEQ ID NO: 73 - DNA, 1446 bp, Artificial Sequence; identical to SEQ ID NO: 25
  Synthetic Construct

SEQ ID NO: 74 - protein, 481 aa, Artificial Sequence; identical to SEQ ID NO: 26
  Synthetic Construct

SEQ ID NO: 75 - DNA, 18 bp, Artificial Sequence
  Synthetic Construct
agtgacagttactggagc

SEQ ID NO: 76 - protein, 6 aa, Artificial Sequence
  Synthetic Construct
SDSYWS

SEQ ID NO: 77 - DNA, 48 bp, Artificial Sequence; identical to SEQ ID NO: 13
  Synthetic Construct

SEQ ID NO: 78 - protein, 16 aa, Artificial Sequence
  Synthetic Construct
YVHKSGDTNYSPSLKS

SEQ ID NO: 79 - DNA, 72 bp, Artificial Sequence; identical to SEQ ID NO: 15
  Synthetic Construct

SEQ ID NO: 80 - protein, 24 aa, Artificial Sequence
  Synthetic Construct
TLHGRRIYGIVAFNEWFTYFYMDV

SEQ ID NO: 81 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggcccccgtattaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 82 - protein, 230 aa, Artificial Sequence
  Synthetic Construct
MMSFVSLLLVGILFHATQASDISVAPGETARISCGEKSLGSRAVQWYQHRAGQAPVLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 83 - DNA, 33 bp, Artificial Sequence; identical to SEQ ID NO: 3
  Synthetic Construct

SEQ ID NO: 84 - protein, 11 aa, Artificial Sequence
  Synthetic Construct
GEKSLGSRAVQ

SEQ ID NO: 85 - DNA, 21 bp, Artificial Sequence
  Synthetic Construct
aataatcaggaccggccctca

SEQ ID NO: 86 - protein, 7 aa, Artificial Sequence
  Synthetic Construct
NNQDRPS

SEQ ID NO: 87 - DNA, 36 bp, Artificial Sequence; identical to SEQ ID NO: 7
  Synthetic Construct

SEQ ID NO: 88 - protein, 12 aa, Artificial Sequence
  Synthetic Construct
HIWDSRVPTKWV

SEQ ID NO: 89 - DNA, 1446 bp, Artificial Sequence; identical to SEQ ID NO: 25
  Synthetic Construct

SEQ ID NO: 90 - protein, 481 aa, Artificial Sequence; identical to SEQ ID NO: 26
  Synthetic Construct

SEQ ID NO: 91 - DNA, 18 bp, Artificial Sequence
  Synthetic Construct
agtgacagttactggagc

SEQ ID NO: 92 - protein, 6 aa, Artificial Sequence
  Synthetic Construct
SDSYWS

SEQ ID NO: 93 - DNA, 48 bp, Artificial Sequence; identical to SEQ ID NO: 13
  Synthetic Construct

SEQ ID NO: 94 - protein, 16 aa, Artificial Sequence
  Synthetic Construct
YVHKSGDTNYSPSLKS

SEQ ID NO: 95 - DNA, 72 bp, Artificial Sequence; identical to SEQ ID NO: 15
  Synthetic Construct

SEQ ID NO: 96 - protein, 24 aa, Artificial Sequence
  Synthetic Construct
TLHGRRIYGIVAFNEWFTYFYMDV

SEQ ID NO: 97 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcctctgactccccttttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 98 - protein, 230 aa, Artificial Sequence
  Synthetic Construct
MMSFVSLLLVGILFHATQASDISVAPGETARISCGEKSLGSRAVQWYQHRAGQAPSLIIYNNQDRPSGIPERFSGSSDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 99 - DNA, 33 bp, Artificial Sequence; identical to SEQ ID NO: 3
  Synthetic Construct

SEQ ID NO: 100 - protein, 11 aa, Artificial Sequence
  Synthetic Construct
GEKSLGSRAVQ

SEQ ID NO: 101 - DNA, 21 bp, Artificial Sequence
  Synthetic Construct
aataatcaggaccggccctca

SEQ ID NO: 102 - protein, 7 aa, Artificial Sequence
  Synthetic Construct
NNQDRPS

SEQ ID NO: 103 - DNA, 36 bp, Artificial Sequence; identical to SEQ ID NO: 7
  Synthetic Construct

SEQ ID NO: 104 - protein, 12 aa, Artificial Sequence
  Synthetic Construct
HIWDSRVPTKWV

SEQ ID NO: 105 - DNA, 1446 bp, Artificial Sequence; identical to SEQ ID NO: 25
  Synthetic Construct

SEQ ID NO: 106 - protein, 481 aa, Artificial Sequence; identical to SEQ ID NO: 26
  Synthetic Construct

SEQ ID NO: 107 - DNA, 18 bp, Artificial Sequence
  Synthetic Construct
agtgacagttactggagc

SEQ ID NO: 108 - protein, 6 aa, Artificial Sequence
  Synthetic Construct
SDSYWS

SEQ ID NO: 109 - DNA, 48 bp, Artificial Sequence; identical to SEQ ID NO: 13
  Synthetic Construct

SEQ ID NO: 110 - protein, 16 aa, Artificial Sequence
  Synthetic Construct
YVHKSGDTNYSPSLKS

SEQ ID NO: 111 - DNA, 72 bp, Artificial Sequence; identical to SEQ ID NO: 15
  Synthetic Construct

SEQ ID NO: 112 - protein, 24 aa, Artificial Sequence
  Synthetic Construct
TLHGRRIYGIVAFNEWFTYFYMDV

SEQ ID NO: 113 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccggatttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 114 - protein, 230 aa, Artificial Sequence
  Synthetic Construct
MMSFVSLLLVGILFHATQASDISVAPGETARISCGEKSLGSRAVQWYQHRAGQAPSLIIYNNQDRPSGIPERFSGSPDSGFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 115 - DNA, 33 bp, Artificial Sequence; identical to SEQ ID NO: 3
  Synthetic Construct

SEQ ID NO: 116 - protein, 11 aa, Artificial Sequence
  Synthetic Construct
GEKSLGSRAVQ

SEQ ID NO: 117 - DNA, 21 bp, Artificial Sequence
  Synthetic Construct
aataatcaggaccggccctca

SEQ ID NO: 118 - protein, 7 aa, Artificial Sequence
  Synthetic Construct
NNQDRPS

SEQ ID NO: 119 - DNA, 36 bp, Artificial Sequence; identical to SEQ ID NO: 7
  Synthetic Construct

SEQ ID NO: 120 - protein, 12 aa, Artificial Sequence
  Synthetic Construct
HIWDSRVPTKWV

SEQ ID NO: 121 - DNA, 1446 bp, Artificial Sequence; identical to SEQ ID NO: 25
  Synthetic Construct

SEQ ID NO: 122 - protein, 481 aa, Artificial Sequence; identical to SEQ ID NO: 26
  Synthetic Construct

SEQ ID NO: 123 - DNA, 18 bp, Artificial Sequence
  Synthetic Construct
agtgacagttactggagc

SEQ ID NO: 124 - protein, 6 aa, Artificial Sequence
  Synthetic Construct
SDSYWS

SEQ ID NO: 125 - DNA, 48 bp, Artificial Sequence; identical to SEQ ID NO: 13
  Synthetic Construct

SEQ ID NO: 126 - protein, 16 aa, Artificial Sequence
  Synthetic Construct
YVHKSGDTNYSPSLKS

SEQ ID NO: 127 - DNA, 72 bp, Artificial Sequence; identical to SEQ ID NO: 15
  Synthetic Construct

SEQ ID NO: 128 - protein, 24 aa, Artificial Sequence
  Synthetic Construct
TLHGRRIYGIVAFNEWFTYFYMDV

SEQ ID NO: 129 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccggagtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 130 - protein, 230 aa, Artificial Sequence
  Synthetic Construct
MMSFVSLLLVGILFHATQASDISVAPGETARISCGEKSLGSRAVQWYQHRAGQAPSLIIYNNQDRPSGIPERFSGSPDSPFGTTATLTITGVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 131 - DNA, 33 bp, Artificial Sequence; identical to SEQ ID NO: 3
  Synthetic Construct

SEQ ID NO: 132 - protein, 11 aa, Artificial Sequence
  Synthetic Construct
GEKSLGSRAVQ

SEQ ID NO: 133 - DNA, 21 bp, Artificial Sequence
  Synthetic Construct
aataatcaggaccggccctca

SEQ ID NO: 134 - protein, 7 aa, Artificial Sequence
  Synthetic Construct
NNQDRPS

SEQ ID NO: 135 - DNA, 36 bp, Artificial Sequence; identical to SEQ ID NO: 7
  Synthetic Construct

SEQ ID NO: 136 - protein, 12 aa, Artificial Sequence
  Synthetic Construct
HIWDSRVPTKWV

SEQ ID NO: 137 - DNA, 1446 bp, Artificial Sequence; identical to SEQ ID NO: 25
  Synthetic Construct

SEQ ID NO: 138 - protein, 481 aa, Artificial Sequence; identical to SEQ ID NO: 26
  Synthetic Construct

SEQ ID NO: 139 - DNA, 18 bp, Artificial Sequence
  Synthetic Construct
agtgacagttactggagc

SEQ ID NO: 140 - protein, 6 aa, Artificial Sequence
  Synthetic Construct
SDSYWS

SEQ ID NO: 141 - DNA, 48 bp, Artificial Sequence; identical to SEQ ID NO: 13
  Synthetic Construct

SEQ ID NO: 142 - protein, 16 aa, Artificial Sequence
  Synthetic Construct
YVHKSGDTNYSPSLKS

SEQ ID NO: 143 - DNA, 72 bp, Artificial Sequence; identical to SEQ ID NO: 15
  Synthetic Construct

SEQ ID NO: 144 - protein, 24 aa, Artificial Sequence
  Synthetic Construct
TLHGRRIYGIVAFNEWFTYFYMDV

SEQ ID NO: 145 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggaaagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 146 - protein, 230 aa, Artificial Sequence
  Synthetic Construct
MMSFVSLLLVGILFHATQASDISVAPGETARISCGEKSLGSRAVQWYQHRAGQAPSLIIYNNQDRPSGIPERFSGSPDSPFGTTATLTITSVEAGDEADYYCHIWESRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 147 - DNA, 33 bp, Artificial Sequence; identical to SEQ ID NO: 3
  Synthetic Construct

SEQ ID NO: 148 - protein, 11 aa, Artificial Sequence
  Synthetic Construct
GEKSLGSRAVQ

SEQ ID NO: 149 - DNA, 21 bp, Artificial Sequence
  Synthetic Construct
aataatcaggaccggccctca

SEQ ID NO: 150 - protein, 7 aa, Artificial Sequence
  Synthetic Construct
NNQDRPS

SEQ ID NO: 151 - DNA, 36 bp, Artificial Sequence
  Synthetic Construct
catatatgggaaagtagagttcccaccaaatgggtc

SEQ ID NO: 152 - protein, 12 aa, Artificial Sequence
  Synthetic Construct
HIWESRVPTKWV

SEQ ID NO: 153 - DNA, 1446 bp, Artificial Sequence; identical to SEQ ID NO: 25
  Synthetic Construct

SEQ ID NO: 154 - protein, 481 aa, Artificial Sequence; identical to SEQ ID NO: 26
  Synthetic Construct

SEQ ID NO: 155 - DNA, 18 bp, Artificial Sequence
  Synthetic Construct
agtgacagttactggagc

SEQ ID NO: 156 - protein, 6 aa, Artificial Sequence
  Synthetic Construct
SDSYWS

SEQ ID NO: 157 - DNA, 48 bp, Artificial Sequence; identical to SEQ ID NO: 13
  Synthetic Construct

SEQ ID NO: 158 - protein, 16 aa, Artificial Sequence
  Synthetic Construct
YVHKSGDTNYSPSLKS

SEQ ID NO: 159 - DNA, 72 bp, Artificial Sequence; identical to SEQ ID NO: 15
  Synthetic Construct

SEQ ID NO: 160 - protein, 24 aa, Artificial Sequence
  Synthetic Construct
TLHGRRIYGIVAFNEWFTYFYMDV

SEQ ID NO: 161 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 162 - protein, 230 aa, Artificial Sequence
  Synthetic Construct
MMSFVSLLLVGILFHATQASDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 163 - DNA, 33 bp, Artificial Sequence; identical to SEQ ID NO: 3
  Synthetic Construct

SEQ ID NO: 164 - protein, 11 aa, Artificial Sequence
  Synthetic Construct
GEKSLGSRAVQ

SEQ ID NO: 165 - DNA, 21 bp, Artificial Sequence
  Synthetic Construct
aataatcaggaccggccctca

SEQ ID NO: 166 - protein, 7 aa, Artificial Sequence
  Synthetic Construct
NNQDRPS

SEQ ID NO: 167 - DNA, 36 bp, Artificial Sequence; identical to SEQ ID NO: 7
  Synthetic Construct

SEQ ID NO: 168 - protein, 12 aa, Artificial Sequence
  Synthetic Construct
HIWDSRVPTKWV

SEQ ID NO: 169 - DNA, 1446 bp, Artificial Sequence; identical to SEQ ID NO: 25
  Synthetic Construct

SEQ ID NO: 170 - protein, 481 aa, Artificial Sequence; identical to SEQ ID NO: 26
  Synthetic Construct

SEQ ID NO: 171 - DNA, 18 bp, Artificial Sequence
  Synthetic Construct
agtgacagttactggagc

SEQ ID NO: 172 - protein, 6 aa, Artificial Sequence
  Synthetic Construct
SDSYWS

SEQ ID NO: 173 - DNA, 48 bp, Artificial Sequence; identical to SEQ ID NO: 13
  Synthetic Construct

SEQ ID NO: 174 - protein, 16 aa, Artificial Sequence
  Synthetic Construct
YVHKSGDTNYSPSLKS

SEQ ID NO: 175 - DNA, 72 bp, Artificial Sequence; identical to SEQ ID NO: 15
  Synthetic Construct

SEQ ID NO: 176 - protein, 24 aa, Artificial Sequence
  Synthetic Construct
TLHGRRIYGIVAFNEWFTYFYMDV

SEQ ID NO: 177 - DNA, 693 bp, Artificial Sequence; identical to SEQ ID NO: 1
  Synthetic Construct

SEQ ID NO: 178 - protein, 230 aa, Artificial Sequence; identical to SEQ ID NO: 2
  Synthetic Construct

SEQ ID NO: 179 - DNA, 33 bp, Artificial Sequence; identical to SEQ ID NO: 3
  Synthetic Construct

SEQ ID NO: 180 - protein, 11 aa, Artificial Sequence
  Synthetic Construct
GEKSLGSRAVQ

SEQ ID NO: 181 - DNA, 21 bp, Artificial Sequence
  Synthetic Construct
aataatcaggaccggccctca

SEQ ID NO: 182 - protein, 7 aa, Artificial Sequence
  Synthetic Construct
NNQDRPS

SEQ ID NO: 183 - DNA, 36 bp, Artificial Sequence; identical to SEQ ID NO: 7
  Synthetic Construct

SEQ ID NO: 184 - protein, 12 aa, Artificial Sequence
  Synthetic Construct
HIWDSRVPTKWV

SEQ ID NO: 185 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgggtccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 186 - protein, 481 aa, Artificial Sequence
  Synthetic Construct
MMSFVSLLLVGILFHATQAQMQLQESGPGLVKPSETLSLTCSVSGGSISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 187 - DNA, 18 bp, Artificial Sequence
  Synthetic Construct
agtgacagttactggagc

SEQ ID NO: 188 - protein, 6 aa, Artificial Sequence
  Synthetic Construct
SDSYWS

SEQ ID NO: 189 - DNA, 48 bp, Artificial Sequence; identical to SEQ ID NO: 13
  Synthetic Construct

SEQ ID NO: 190 - protein, 16 aa, Artificial Sequence
  Synthetic Construct
YVHKSGDTNYSPSLKS

SEQ ID NO: 191 - DNA, 72 bp, Artificial Sequence; identical to SEQ ID NO: 15
  Synthetic Construct

SEQ ID NO: 192 - protein, 24 aa, Artificial Sequence
  Synthetic Construct
TLHGRRIYGIVAFNEWFTYFYMDV

SEQ ID NO: 193 - DNA, 693 bp, Artificial Sequence; identical to SEQ ID NO: 1
  Synthetic Construct

SEQ ID NO: 194 - protein, 230 aa, Artificial Sequence; identical to SEQ ID NO: 2
  Synthetic Construct

SEQ ID NO: 195 - DNA, 33 bp, Artificial Sequence; identical to SEQ ID NO: 3
  Synthetic Construct

SEQ ID NO: 196 - protein, 11 aa, Artificial Sequence
  Synthetic Construct
GEKSLGSRAVQ

SEQ ID NO: 197 - DNA, 21 bp, Artificial Sequence
  Synthetic Construct
aataatcaggaccggccctca

SEQ ID NO: 198 - protein, 7 aa, Artificial Sequence
  Synthetic Construct
NNQDRPS

SEQ ID NO: 199 - DNA, 36 bp, Artificial Sequence; identical to SEQ ID NO: 7
  Synthetic Construct

SEQ ID NO: 200 - protein, 12 aa, Artificial Sequence
  Synthetic Construct
HIWDSRVPTKWV

SEQ ID NO: 201 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgagagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 202 - protein, 481 aa, Artificial Sequence
  Synthetic Construct
MMSFVSLLLVGILFHATQAQMQLQESGPGLVKPSETLSLTCSVSGASISESYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 203 - DNA, 18 bp, Artificial Sequence
  Synthetic Construct
agtgagagttactggagc

SEQ ID NO: 204 - protein, 6 aa, Artificial Sequence
  Synthetic Construct
SESYWS

SEQ ID NO: 205 - DNA, 48 bp, Artificial Sequence; identical to SEQ ID NO: 13
  Synthetic Construct

SEQ ID NO: 206 - protein, 16 aa, Artificial Sequence
  Synthetic Construct
YVHKSGDTNYSPSLKS

SEQ ID NO: 207 - DNA, 72 bp, Artificial Sequence; identical to SEQ ID NO: 15
  Synthetic Construct

SEQ ID NO: 208 - protein, 24 aa, Artificial Sequence
  Synthetic Construct
TLHGRRIYGIVAFNEWFTYFYMDV

SEQ ID NO: 209 - DNA, 693 bp, Artificial Sequence; identical to SEQ ID NO: 1
  Synthetic Construct

SEQ ID NO: 210 - protein, 230 aa, Artificial Sequence; identical to SEQ ID NO: 2
  Synthetic Construct

SEQ ID NO: 211 - DNA, 33 bp, Artificial Sequence; identical to SEQ ID NO: 3
  Synthetic Construct

SEQ ID NO: 212 - protein, 11 aa, Artificial Sequence
  Synthetic Construct
GEKSLGSRAVQ

SEQ ID NO: 213 - DNA, 21 bp, Artificial Sequence
  Synthetic Construct
aataatcaggaccggccctca

SEQ ID NO: 214 - protein, 7 aa, Artificial Sequence
  Synthetic Construct
NNQDRPS

SEQ ID NO: 215 - DNA, 36 bp, Artificial Sequence; identical to SEQ ID NO: 7
  Synthetic Construct

SEQ ID NO: 216 - protein, 12 aa, Artificial Sequence
  Synthetic Construct
HIWDSRVPTKWV

SEQ ID NO: 217 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagttctagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 218 - protein, 481 aa, Artificial Sequence
  Synthetic Construct
MMSFVSLLLVGILFHATQAQMQLQESGPGLVKPSETLSLTCSVSGASISSSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 219 - DNA, 18 bp, Artificial Sequence
  Synthetic Construct
agttctagttactggagc

SEQ ID NO: 220 - protein, 6 aa, Artificial Sequence
  Synthetic Construct
SSSYWS

SEQ ID NO: 221 - DNA, 48 bp, Artificial Sequence; identical to SEQ ID NO: 13
  Synthetic Construct

SEQ ID NO: 222 - protein, 16 aa, Artificial Sequence
  Synthetic Construct
YVHKSGDTNYSPSLKS

SEQ ID NO: 223 - DNA, 72 bp, Artificial Sequence; identical to SEQ ID NO: 15
  Synthetic Construct

SEQ ID NO: 224 - protein, 24 aa, Artificial Sequence
  Synthetic Construct
TLHGRRIYGIVAFNEWFTYFYMDV

SEQ ID NO: 225 - DNA, 693 bp, Artificial Sequence; identical to SEQ ID NO: 1
  Synthetic Construct

SEQ ID NO: 226 - protein, 230 aa, Artificial Sequence; identical to SEQ ID NO: 2
  Synthetic Construct

SEQ ID NO: 227 - DNA, 33 bp, Artificial Sequence; identical to SEQ ID NO: 3
  Synthetic Construct

SEQ ID NO: 228 - protein, 11 aa, Artificial Sequence
  Synthetic Construct
GEKSLGSRAVQ

SEQ ID NO: 229 - DNA, 21 bp, Artificial Sequence
  Synthetic Construct
aataatcaggaccggccctca

SEQ ID NO: 230 - protein, 7 aa, Artificial Sequence
  Synthetic Construct
NNQDRPS

SEQ ID NO: 231 - DNA, 36 bp, Artificial Sequence; identical to SEQ ID NO: 7
  Synthetic Construct

SEQ ID NO: 232 - protein, 12 aa, Artificial Sequence
  Synthetic Construct
HIWDSRVPTKWV

SEQ ID NO: 233 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaatccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 234 - protein, 481 aa, Artificial Sequence
  Synthetic Construct
MMSFVSLLLVGILFHATQAQMQLQESGPGLVKPSETLSLTCSVSGASISDSYWSWIRQSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 235 - DNA, 18 bp, Artificial Sequence
  Synthetic Construct
agtgacagttactggagc

SEQ ID NO: 236 - protein, 6 aa, Artificial Sequence
  Synthetic Construct
SDSYWS

SEQ ID NO: 237 - DNA, 48 bp, Artificial Sequence; identical to SEQ ID NO: 13
  Synthetic Construct

SEQ ID NO: 238 - protein, 16 aa, Artificial Sequence
  Synthetic Construct
YVHKSGDTNYSPSLKS

SEQ ID NO: 239 - DNA, 72 bp, Artificial Sequence; identical to SEQ ID NO: 15
  Synthetic Construct

SEQ ID NO: 240 - protein, 24 aa, Artificial Sequence
  Synthetic Construct
TLHGRRIYGIVAFNEWFTYFYMDV

SEQ ID NO: 241 - DNA, 693 bp, Artificial Sequence; identical to SEQ ID NO: 1
  Synthetic Construct

SEQ ID NO: 242 - protein, 230 aa, Artificial Sequence; identical to SEQ ID NO: 2
  Synthetic Construct

SEQ ID NO: 243 - DNA, 33 bp, Artificial Sequence; identical to SEQ ID NO: 3
  Synthetic Construct

SEQ ID NO: 244 - protein, 11 aa, Artificial Sequence
  Synthetic Construct
GEKSLGSRAVQ

SEQ ID NO: 245 - DNA, 21 bp, Artificial Sequence
  Synthetic Construct
aataatcaggaccggccctca

SEQ ID NO: 246 - protein, 7 aa, Artificial Sequence
  Synthetic Construct
NNQDRPS

SEQ ID NO: 247 - DNA, 36 bp, Artificial Sequence; identical to SEQ ID NO: 7
  Synthetic Construct

SEQ ID NO: 248 - protein, 12 aa, Artificial Sequence
  Synthetic Construct
HIWDSRVPTKWV

SEQ ID NO: 249 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggccgccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 250 - protein, 481 aa, Artificial Sequence
  Synthetic Construct
MMSFVSLLLVGILFHATQAQMQLQESGPGLVKPSETLSLTCSVSGASISDSYWSWIRRPPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 251 - DNA, 18 bp, Artificial Sequence
  Synthetic Construct
agtgacagttactggagc

SEQ ID NO: 252 - protein, 6 aa, Artificial Sequence
  Synthetic Construct
SDSYWS

SEQ ID NO: 253 - DNA, 48 bp, Artificial Sequence; identical to SEQ ID NO: 13
  Synthetic Construct

SEQ ID NO: 254 - protein, 16 aa, Artificial Sequence
  Synthetic Construct
YVHKSGDTNYSPSLKS

SEQ ID NO: 255 - DNA, 72 bp, Artificial Sequence; identical to SEQ ID NO: 15
  Synthetic Construct

SEQ ID NO: 256 - protein, 24 aa, Artificial Sequence
  Synthetic Construct
TLHGRRIYGIVAFNEWFTYFYMDV

SEQ ID NO: 257 - DNA, 693 bp, Artificial Sequence; identical to SEQ ID NO: 1
  Synthetic Construct

SEQ ID NO: 258 - protein, 230 aa, Artificial Sequence; identical to SEQ ID NO: 2
  Synthetic Construct

SEQ ID NO: 259 - DNA, 33 bp, Artificial Sequence; identical to SEQ ID NO: 3
  Synthetic Construct

SEQ ID NO: 260 - protein, 11 aa, Artificial Sequence
  Synthetic Construct
GEKSLGSRAVQ

SEQ ID NO: 261 - DNA, 21 bp, Artificial Sequence
  Synthetic Construct
aataatcaggaccggccctca

SEQ ID NO: 262 - protein, 7 aa, Artificial Sequence
  Synthetic Construct
NNQDRPS

SEQ ID NO: 263 - DNA, 36 bp, Artificial Sequence; identical to SEQ ID NO: 7
  Synthetic Construct

SEQ ID NO: 264 - protein, 12 aa, Artificial Sequence
  Synthetic Construct
HIWDSRVPTKWV

SEQ ID NO: 265 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgaaacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 266 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGETNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 267 - DNA, 18 bp, Artificial Sequence
  Synthetic Construct
agtgacagttactggagc

SEQ ID NO: 268 - protein, 6 aa, Artificial Sequence
  Synthetic Construct
SDSYWS

SEQ ID NO: 269 - DNA, 48 bp, Artificial Sequence
  Synthetic Construct
tatgtccacaaaagcggcgaaacaaattacagcccctccctcaagagt

SEQ ID NO: 270 - protein, 16 aa, Artificial Sequence
  Synthetic Construct
YVHKSGETNYSPSLKS

SEQ ID NO: 271 - DNA, 72 bp, Artificial Sequence; identical to SEQ ID NO: 15
  Synthetic Construct

SEQ ID NO: 272 - protein, 24 aa, Artificial Sequence
  Synthetic Construct
TLHGRRIYGIVAFNEWFTYFYMDV

SEQ ID NO: 273 - DNA, 693 bp, Artificial Sequence; identical to SEQ ID NO: 1
  Synthetic Construct

SEQ ID NO: 274 - protein, 230 aa, Artificial Sequence; identical to SEQ ID NO: 2
  Synthetic Construct

SEQ ID NO: 275 - DNA, 33 bp, Artificial Sequence; identical to SEQ ID NO: 3
  Synthetic Construct

SEQ ID NO: 276 - protein, 11 aa, Artificial Sequence
  Synthetic Construct
GEKSLGSRAVQ

SEQ ID NO: 277 - DNA, 21 bp, Artificial Sequence
  Synthetic Construct
aataatcaggaccggccctca

SEQ ID NO: 278 - protein, 7 aa, Artificial Sequence
  Synthetic Construct
NNQDRPS

SEQ ID NO: 279 - DNA, 36 bp, Artificial Sequence; identical to SEQ ID NO: 7
  Synthetic Construct

SEQ ID NO: 280 - protein, 12 aa, Artificial Sequence
  Synthetic Construct
HIWDSRVPTKWV

SEQ ID NO: 281 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggctcaacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 282 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGSTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 283 - DNA, 18 bp, Artificial Sequence
  Synthetic Construct
agtgacagttactggagc

SEQ ID NO: 284 - protein, 6 aa, Artificial Sequence
  Synthetic Construct
SDSYWS

SEQ ID NO: 285 - DNA, 48 bp, Artificial Sequence
  Synthetic Construct
tatgtccacaaaagcggctcaacaaattacagcccctccctcaagagt

SEQ ID NO: 286 - protein, 16 aa, Artificial Sequence
  Synthetic Construct
YVHKSGSTNYSPSLKS

SEQ ID NO: 287 - DNA, 72 bp, Artificial Sequence; identical to SEQ ID NO: 15
  Synthetic Construct

SEQ ID NO: 288 - protein, 24 aa, Artificial Sequence
  Synthetic Construct
TLHGRRIYGIVAFNEWFTYFYMDV

SEQ ID NO: 289 - DNA, 693 bp, Artificial Sequence; identical to SEQ ID NO: 1
  Synthetic Construct

SEQ ID NO: 290 - protein, 230 aa, Artificial Sequence; identical to SEQ ID NO: 2
  Synthetic Construct

SEQ ID NO: 291 - DNA, 33 bp, Artificial Sequence; identical to SEQ ID NO: 3
  Synthetic Construct

SEQ ID NO: 292 - protein, 11 aa, Artificial Sequence
  Synthetic Construct
GEKSLGSRAVQ

SEQ ID NO: 293 - DNA, 21 bp, Artificial Sequence
  Synthetic Construct
aataatcaggaccggccctca

SEQ ID NO: 294 - protein, 7 aa, Artificial Sequence
  Synthetic Construct
NNQDRPS

SEQ ID NO: 295 - DNA, 36 bp, Artificial Sequence; identical to SEQ ID NO: 7
  Synthetic Construct

SEQ ID NO: 296 - protein, 12 aa, Artificial Sequence
  Synthetic Construct
HIWDSRVPTKWV

SEQ ID NO: 297 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcacattgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 298 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVTLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 299 - DNA, 18 bp, Artificial Sequence
  Synthetic Construct
agtgacagttactggagc

SEQ ID NO: 300 - protein, 6 aa, Artificial Sequence
  Synthetic Construct
SDSYWS

SEQ ID NO: 301 - DNA, 48 bp, Artificial Sequence; identical to SEQ ID NO: 13
  Synthetic Construct

SEQ ID NO: 302 - protein, 16 aa, Artificial Sequence
  Synthetic Construct
YVHKSGDTNYSPSLKS

SEQ ID NO: 303 - DNA, 72 bp, Artificial Sequence; identical to SEQ ID NO: 15
  Synthetic Construct

SEQ ID NO: 304 - protein, 24 aa, Artificial Sequence
  Synthetic Construct
TLHGRRIYGIVAFNEWFTYFYMDV

SEQ ID NO: 305 - DNA, 693 bp, Artificial Sequence; identical to SEQ ID NO: 1
  Synthetic Construct

SEQ ID NO: 306 - protein, 230 aa, Artificial Sequence; identical to SEQ ID NO: 2
  Synthetic Construct

SEQ ID NO: 307 - DNA, 33 bp, Artificial Sequence; identical to SEQ ID NO: 3
  Synthetic Construct

SEQ ID NO: 308 - protein, 11 aa, Artificial Sequence
  Synthetic Construct
GEKSLGSRAVQ

SEQ ID NO: 309 - DNA, 21 bp, Artificial Sequence
  Synthetic Construct
aataatcaggaccggccctca

SEQ ID NO: 310 - protein, 7 aa, Artificial Sequence
  Synthetic Construct
NNQDRPS

SEQ ID NO: 311 - DNA, 36 bp, Artificial Sequence; identical to SEQ ID NO: 7
  Synthetic Construct

SEQ ID NO: 312 - protein, 12 aa, Artificial Sequence
  Synthetic Construct
HIWDSRVPTKWV

SEQ ID NO: 313 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcagttctccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 314 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVNLSLDTSKNQFSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 315 - DNA, 18 bp, Artificial Sequence
  Synthetic Construct
agtgacagttactggagc

SEQ ID NO: 316 - protein, 6 aa, Artificial Sequence
  Synthetic Construct
SDSYWS

SEQ ID NO: 317 - DNA, 48 bp, Artificial Sequence; identical to SEQ ID NO: 13
  Synthetic Construct

SEQ ID NO: 318 - protein, 16 aa, Artificial Sequence
  Synthetic Construct
YVHKSGDTNYSPSLKS

SEQ ID NO: 319 - DNA, 72 bp, Artificial Sequence; identical to SEQ ID NO: 15
  Synthetic Construct

SEQ ID NO: 320 - protein, 24 aa, Artificial Sequence
  Synthetic Construct
TLHGRRIYGIVAFNEWFTYFYMDV

SEQ ID NO: 321 - DNA, 693 bp, Artificial Sequence; identical to SEQ ID NO: 1
  Synthetic Construct

SEQ ID NO: 322 - protein, 230 aa, Artificial Sequence; identical to SEQ ID NO: 2
  Synthetic Construct

SEQ ID NO: 323 - DNA, 33 bp, Artificial Sequence; identical to SEQ ID NO: 3
  Synthetic Construct

SEQ ID NO: 324 - protein, 11 aa, Artificial Sequence
  Synthetic Construct
GEKSLGSRAVQ

SEQ ID NO: 325 - DNA, 21 bp, Artificial Sequence
  Synthetic Construct
aataatcaggaccggccctca

SEQ ID NO: 326 - protein, 7 aa, Artificial Sequence
  Synthetic Construct
NNQDRPS

SEQ ID NO: 327 - DNA, 36 bp, Artificial Sequence; identical to SEQ ID NO: 7
  Synthetic Construct

SEQ ID NO: 328 - protein, 12 aa, Artificial Sequence
  Synthetic Construct
HIWDSRVPTKWV

SEQ ID NO: 329 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgaagcttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 330 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVNLSLDTSKNQVSLKLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 331 - DNA, 18 bp, Artificial Sequence
  Synthetic Construct
agtgacagttactggagc

SEQ ID NO: 332 - protein, 6 aa, Artificial Sequence
  Synthetic Construct
SDSYWS

SEQ ID NO: 333 - DNA, 48 bp, Artificial Sequence; identical to SEQ ID NO: 13
  Synthetic Construct

SEQ ID NO: 334 - protein, 16 aa, Artificial Sequence
  Synthetic Construct
YVHKSGDTNYSPSLKS

SEQ ID NO: 335 - DNA, 72 bp, Artificial Sequence; identical to SEQ ID NO: 15
  Synthetic Construct

SEQ ID NO: 336 - protein, 24 aa, Artificial Sequence
  Synthetic Construct
TLHGRRIYGIVAFNEWFTYFYMDV

SEQ ID NO: 337 - DNA, 693 bp, Artificial Sequence; identical to SEQ ID NO: 1
  Synthetic Construct

SEQ ID NO: 338 - protein, 230 aa, Artificial Sequence; identical to SEQ ID NO: 2
  Synthetic Construct

SEQ ID NO: 339 - DNA, 33 bp, Artificial Sequence; identical to SEQ ID NO: 3
  Synthetic Construct

SEQ ID NO: 340 - protein, 11 aa, Artificial Sequence
  Synthetic Construct
GEKSLGSRAVQ

SEQ ID NO: 341 - DNA, 21 bp, Artificial Sequence
  Synthetic Construct
aataatcaggaccggccctca

SEQ ID NO: 342 - protein, 7 aa, Artificial Sequence
  Synthetic Construct
NNQDRPS

SEQ ID NO: 343 - DNA, 36 bp, Artificial Sequence; identical to SEQ ID NO: 7
  Synthetic Construct

SEQ ID NO: 344 - protein, 12 aa, Artificial Sequence
  Synthetic Construct
HIWDSRVPTKWV

SEQ ID NO: 345 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 346 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVNLSLDTSKNQVSLSLSAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 347 - DNA, 18 bp, Artificial Sequence
  Synthetic Construct
agtgacagttactggagc

SEQ ID NO: 348 - protein, 6 aa, Artificial Sequence
  Synthetic Construct
SDSYWS

SEQ ID NO: 349 - DNA, 48 bp, Artificial Sequence; identical to SEQ ID NO: 13
  Synthetic Construct

SEQ ID NO: 350 - protein, 16 aa, Artificial Sequence
  Synthetic Construct
YVHKSGDTNYSPSLKS

SEQ ID NO: 351 - DNA, 72 bp, Artificial Sequence; identical to SEQ ID NO: 15
  Synthetic Construct

SEQ ID NO: 352 - protein, 24 aa, Artificial Sequence
  Synthetic Construct
TLHGRRIYGIVAFNEWFTYFYMDV

SEQ ID NO: 353 - DNA, 693 bp, Artificial Sequence; identical to SEQ ID NO: 1
  Synthetic Construct

SEQ ID NO: 354 - protein, 230 aa, Artificial Sequence; identical to SEQ ID NO: 2
  Synthetic Construct

SEQ ID NO: 355 - DNA, 33 bp, Artificial Sequence; identical to SEQ ID NO: 3
  Synthetic Construct

SEQ ID NO: 356 - protein, 11 aa, Artificial Sequence
  Synthetic Construct
GEKSLGSRAVQ

SEQ ID NO: 357 - DNA, 21 bp, Artificial Sequence
  Synthetic Construct
aataatcaggaccggccctca

SEQ ID NO: 358 - protein, 7 aa, Artificial Sequence
  Synthetic Construct
NNQDRPS

SEQ ID NO: 359 - DNA, 36 bp, Artificial Sequence; identical to SEQ ID NO: 7
  Synthetic Construct

SEQ ID NO: 360 - protein, 12 aa, Artificial Sequence
  Synthetic Construct
HIWDSRVPTKWV

SEQ ID NO: 361 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtgtctgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 362 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVNLSLDTSKNQVSLSLVSATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 363 - DNA, 18 bp, Artificial Sequence
  Synthetic Construct
agtgacagttactggagc

SEQ ID NO: 364 - protein, 6 aa, Artificial Sequence
  Synthetic Construct
SDSYWS

SEQ ID NO: 365 - DNA, 48 bp, Artificial Sequence; identical to SEQ ID NO: 13
  Synthetic Construct

SEQ ID NO: 366 - protein, 16 aa, Artificial Sequence
  Synthetic Construct
YVHKSGDTNYSPSLKS

SEQ ID NO: 367 - DNA, 72 bp, Artificial Sequence; identical to SEQ ID NO: 15
  Synthetic Construct

SEQ ID NO: 368 - protein, 24 aa, Artificial Sequence
  Synthetic Construct
TLHGRRIYGIVAFNEWFTYFYMDV

SEQ ID NO: 369 - DNA, 693 bp, Artificial Sequence; identical to SEQ ID NO: 1
  Synthetic Construct

SEQ ID NO: 370 - protein, 230 aa, Artificial Sequence; identical to SEQ ID NO: 2
  Synthetic Construct

SEQ ID NO: 371 - DNA, 33 bp, Artificial Sequence; identical to SEQ ID NO: 3
  Synthetic Construct

SEQ ID NO: 372 - protein, 11 aa, Artificial Sequence
  Synthetic Construct
GEKSLGSRAVQ

SEQ ID NO: 373 - DNA, 21 bp, Artificial Sequence
  Synthetic Construct
aataatcaggaccggccctca

SEQ ID NO: 374 - protein, 7 aa, Artificial Sequence
  Synthetic Construct
NNQDRPS

SEQ ID NO: 375 - DNA, 36 bp, Artificial Sequence; identical to SEQ ID NO: 7
  Synthetic Construct

SEQ ID NO: 376 - protein, 12 aa, Artificial Sequence
  Synthetic Construct
HIWDSRVPTKWV

SEQ ID NO: 377 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcgtctattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 378 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVNLSLDTSKNQVSLSLVAATAADSGVYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 379 - DNA, 18 bp, Artificial Sequence
  Synthetic Construct
agtgacagttactggagc

SEQ ID NO: 380 - protein, 6 aa, Artificial Sequence
  Synthetic Construct
SDSYWS

SEQ ID NO: 381 - DNA, 48 bp, Artificial Sequence; identical to SEQ ID NO: 13
  Synthetic Construct

SEQ ID NO: 382 - protein, 16 aa, Artificial Sequence
  Synthetic Construct
YVHKSGDTNYSPSLKS

SEQ ID NO: 383 - DNA, 72 bp, Artificial Sequence; identical to SEQ ID NO: 15
  Synthetic Construct

SEQ ID NO: 384 - protein, 24 aa, Artificial Sequence
  Synthetic Construct
TLHGRRIYGIVAFNEWFTYFYMDV

SEQ ID NO: 385 - DNA, 693 bp, Artificial Sequence; identical to SEQ ID NO: 1
  Synthetic Construct

SEQ ID NO: 386 - protein, 230 aa, Artificial Sequence; identical to SEQ ID NO: 2
  Synthetic Construct

SEQ ID NO: 387 - DNA, 33 bp, Artificial Sequence; identical to SEQ ID NO: 3
  Synthetic Construct

SEQ ID NO: 388 - protein, 11 aa, Artificial Sequence
  Synthetic Construct
GEKSLGSRAVQ

SEQ ID NO: 389 - DNA, 21 bp, Artificial Sequence
  Synthetic Construct
aataatcaggaccggccctca

SEQ ID NO: 390 - protein, 7 aa, Artificial Sequence
  Synthetic Construct
NNQDRPS

SEQ ID NO: 391 - DNA, 36 bp, Artificial Sequence; identical to SEQ ID NO: 7
  Synthetic Construct

SEQ ID NO: 392 - protein, 12 aa, Artificial Sequence
  Synthetic Construct
HIWDSRVPTKWV

SEQ ID NO: 393 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggccaggggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 394 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 395 - DNA, 18 bp, Artificial Sequence
  Synthetic Construct
agtgacagttactggagc

SEQ ID NO: 396 - protein, 6 aa, Artificial Sequence
  Synthetic Construct
SDSYWS

SEQ ID NO: 397 - DNA, 48 bp, Artificial Sequence; identical to SEQ ID NO: 13
  Synthetic Construct

SEQ ID NO: 398 - protein, 16 aa, Artificial Sequence
  Synthetic Construct
YVHKSGDTNYSPSLKS

SEQ ID NO: 399 - DNA, 72 bp, Artificial Sequence; identical to SEQ ID NO: 15
  Synthetic Construct

SEQ ID NO: 400 - protein, 24 aa, Artificial Sequence
  Synthetic Construct
TLHGRRIYGIVAFNEWFTYFYMDV

SEQ ID NO: 401 - DNA, 693 bp, Artificial Sequence
  Synthetic Construct
atgatgtcctttgtctctctgctcctggttggcatcctattccatgccacccaggccccctccatatctgtggccccaggacagacggccaggatttcctgtggggaaaagagccttggaagtagagctgtacaatggtatcaacagagggccggccaggcccccgtattaatcatatataataatcaggaccggccctcagggatccctgagcgattctctggctcccctgactccccttttgggaccacggccaccctgaccatcaccggagtcgaagccggggatgaggccgactattactgtcatatatgggatagtagagttcccaccaaatgggtcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 402 - protein, 230 aa, Artificial Sequence
  Synthetic Construct
MMSFVSLLLVGILFHATQAPSISVAPGQTARISCGEKSLGSRAVQWYQQRAGQAPVLIIYNNQDRPSGIPERFSGSPDSPFGTTATLTITGVEAGDEADYYCHIWDSRVPTKWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 403 - DNA, 33 bp, Artificial Sequence; identical to SEQ ID NO: 3
  Synthetic Construct

SEQ ID NO: 404 - protein, 11 aa, Artificial Sequence
  Synthetic Construct
GEKSLGSRAVQ

SEQ ID NO: 405 - DNA, 21 bp, Artificial Sequence
  Synthetic Construct
aataatcaggaccggccctca

SEQ ID NO: 406 - protein, 7 aa, Artificial Sequence
  Synthetic Construct
NNQDRPS

SEQ ID NO: 407 - DNA, 36 bp, Artificial Sequence; identical to SEQ ID NO: 7
  Synthetic Construct

SEQ ID NO: 408 - protein, 12 aa, Artificial Sequence
  Synthetic Construct
HIWDSRVPTKWV

SEQ ID NO: 409 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaaccgccagggaagggacttgagtggattgggtatgtccacaaaagcggcgacacaaattacagcccctccctcaagagtcgagtcaacttgtcgttagacacgtccaaaaatcaggtgtccctgaagctttcttctgcgaccgctgcggactcgggcgtctattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 410 - protein, 481 aa, Artificial Sequence
  Synthetic Construct
MMSFVSLLLVGILFHATQAQMQLQESGPGLVKPSETLSLTCSVSGASISDSYWSWIRQPPGKGLEWIGYVHKSGDTNYSPSLKSRVNLSLDTSKNQVSLKLSSATAADSGVYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 411 - DNA, 18 bp, Artificial Sequence
  Synthetic Construct
agtgacagttactggagc

SEQ ID NO: 412 - protein, 6 aa, Artificial Sequence
  Synthetic Construct
SDSYWS

SEQ ID NO: 413 - DNA, 48 bp, Artificial Sequence; identical to SEQ ID NO: 13
  Synthetic Construct

SEQ ID NO: 414 - protein, 16 aa, Artificial Sequence
  Synthetic Construct
YVHKSGDTNYSPSLKS

SEQ ID NO: 415 - DNA, 72 bp, Artificial Sequence; identical to SEQ ID NO: 15
  Synthetic Construct

SEQ ID NO: 416 - protein, 24 aa, Artificial Sequence
  Synthetic Construct
TLHGRRIYGIVAFNEWFTYFYMDV

SEQ ID NO: 417 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcctctgactccggatttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 418 - protein, 230 aa, Artificial Sequence
  Synthetic Construct
MMSFVSLLLVGILFHATQASDISVAPGETARISCGEKSLGSRAVQWYQHRAGQAPSLIIYNNQDRPSGIPERFSGSSDSGFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 419 - DNA, 33 bp, Artificial Sequence; identical to SEQ ID NO: 3
  Synthetic Construct

SEQ ID NO: 420 - protein, 11 aa, Artificial Sequence
  Synthetic Construct
GEKSLGSRAVQ

SEQ ID NO: 421 - DNA, 21 bp, Artificial Sequence
  Synthetic Construct
aataatcaggaccggccctca

SEQ ID NO: 422 - protein, 7 aa, Artificial Sequence
  Synthetic Construct
NNQDRPS

SEQ ID NO: 423 - DNA, 36 bp, Artificial Sequence; identical to SEQ ID NO: 7
  Synthetic Construct

SEQ ID NO: 424 - protein, 12 aa, Artificial Sequence
  Synthetic Construct
HIWDSRVPTKWV

SEQ ID NO: 425 - DNA, 1446 bp, Artificial Sequence; identical to SEQ ID NO: 25
  Synthetic Construct

SEQ ID NO: 426 - protein, 481 aa, Artificial Sequence; identical to SEQ ID NO: 26
  Synthetic Construct

SEQ ID NO: 427 - DNA, 18 bp, Artificial Sequence
  Synthetic Construct
agtgacagttactggagc

SEQ ID NO: 428 - protein, 6 aa, Artificial Sequence
  Synthetic Construct
SDSYWS

SEQ ID NO: 429 - DNA, 48 bp, Artificial Sequence; identical to SEQ ID NO: 13
  Synthetic Construct

SEQ ID NO: 430 - protein, 16 aa, Artificial Sequence
  Synthetic Construct
YVHKSGDTNYSPSLKS

SEQ ID NO: 431 - DNA, 72 bp, Artificial Sequence; identical to SEQ ID NO: 15
  Synthetic Construct

SEQ ID NO: 432 - protein, 24 aa, Artificial Sequence
  Synthetic Construct
TLHGRRIYGIVAFNEWFTYFYMDV

SEQ ID NO: 433 - DNA, 693 bp, Artificial Sequence; identical to SEQ ID NO: 1
  Synthetic Construct

SEQ ID NO: 434 - protein, 230 aa, Artificial Sequence; identical to SEQ ID NO: 2
  Synthetic Construct

SEQ ID NO: 435 - DNA, 33 bp, Artificial Sequence; identical to SEQ ID NO: 3
  Synthetic Construct

SEQ ID NO: 436 - protein, 11 aa, Artificial Sequence
  Synthetic Construct
GEKSLGSRAVQ

SEQ ID NO: 437 - DNA, 21 bp, Artificial Sequence
  Synthetic Construct
aataatcaggaccggccctca

SEQ ID NO: 438 - protein, 7 aa, Artificial Sequence
  Synthetic Construct
NNQDRPS

SEQ ID NO: 439 - DNA, 36 bp, Artificial Sequence; identical to SEQ ID NO: 7
  Synthetic Construct

SEQ ID NO: 440 - protein, 12 aa, Artificial Sequence
  Synthetic Construct
HIWDSRVPTKWV

SEQ ID NO: 441 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgaagctttcttctgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 442 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVNLSLDTSKNQVSLKLSSATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 443 - DNA, 18 bp, Artificial Sequence
  Synthetic Construct
agtgacagttactggagc

SEQ ID NO: 444 - protein, 6 aa, Artificial Sequence
  Synthetic Construct
SDSYWS

SEQ ID NO: 445 - DNA, 48 bp, Artificial Sequence; identical to SEQ ID NO: 13
  Synthetic Construct

SEQ ID NO: 446 - protein, 16 aa, Artificial Sequence
  Synthetic Construct
YVHKSGDTNYSPSLKS

SEQ ID NO: 447 - DNA, 72 bp, Artificial Sequence; identical to SEQ ID NO: 15
  Synthetic Construct

SEQ ID NO: 448 - protein, 24 aa, Artificial Sequence
  Synthetic Construct
TLHGRRIYGIVAFNEWFTYFYMDV

SEQ ID NO: 449 - DNA, 693 bp, Artificial Sequence; identical to SEQ ID NO: 1
  Synthetic Construct

SEQ ID NO: 450 - protein, 230 aa, Artificial Sequence; identical to SEQ ID NO: 2
  Synthetic Construct

SEQ ID NO: 451 - DNA, 33 bp, Artificial Sequence; identical to SEQ ID NO: 3
  Synthetic Construct

SEQ ID NO: 452 - protein, 11 aa, Artificial Sequence
  Synthetic Construct
GEKSLGSRAVQ

SEQ ID NO: 453 - DNA, 21 bp, Artificial Sequence
  Synthetic Construct
aataatcaggaccggccctca

SEQ ID NO: 454 - protein, 7 aa, Artificial Sequence
  Synthetic Construct
NNQDRPS

SEQ ID NO: 455 - DNA, 36 bp, Artificial Sequence; identical to SEQ ID NO: 7
  Synthetic Construct

SEQ ID NO: 456 - protein, 12 aa, Artificial Sequence
  Synthetic Construct
HIWDSRVPTKWV

SEQ ID NO: 457 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcacattgtcgttagacacgtccaaaaatcaggtgtccctgaagctttcttctgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 458 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGDTNYSPSLKSRVTLSLDTSKNQVSLKLSSATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 459 - DNA, 18 bp, Artificial Sequence
  Synthetic Construct
agtgacagttactggagc

SEQ ID NO: 460 - protein, 6 aa, Artificial Sequence
  Synthetic Construct
SDSYWS

SEQ ID NO: 461 - DNA, 48 bp, Artificial Sequence; identical to SEQ ID NO: 13
  Synthetic Construct

SEQ ID NO: 462 - protein, 16 aa, Artificial Sequence
  Synthetic Construct
YVHKSGDTNYSPSLKS

SEQ ID NO: 463 - DNA, 72 bp, Artificial Sequence; identical to SEQ ID NO: 15
  Synthetic Construct

SEQ ID NO: 464 - protein, 24 aa, Artificial Sequence
  Synthetic Construct
TLHGRRIYGIVAFNEWFTYFYMDV

SEQ ID NO: 465 - DNA, 693 bp, Artificial Sequence; identical to SEQ ID NO: 65
  Synthetic Construct

SEQ ID NO: 466 - protein, 230 aa, Artificial Sequence; identical to SEQ ID NO: 66
  Synthetic Construct

SEQ ID NO: 467 - DNA, 33 bp, Artificial Sequence; identical to SEQ ID NO: 3
  Synthetic Construct

SEQ ID NO: 468 - protein, 11 aa, Artificial Sequence
  Synthetic Construct
GEKSLGSRAVQ

SEQ ID NO: 469 - DNA, 21 bp, Artificial Sequence
  Synthetic Construct
aataatcaggaccggccctca

SEQ ID NO: 470 - protein, 7 aa, Artificial Sequence
  Synthetic Construct
NNQDRPS

SEQ ID NO: 471 - DNA, 36 bp, Artificial Sequence; identical to SEQ ID NO: 7
  Synthetic Construct

SEQ ID NO: 472 - protein, 12 aa, Artificial Sequence
  Synthetic Construct
HIWDSRVPTKWV

SEQ ID NO: 473 - DNA, 1446 bp, Artificial Sequence; identical to SEQ ID NO: 233
  Synthetic Construct

SEQ ID NO: 474 - protein, 481 aa, Artificial Sequence; identical to SEQ ID NO: 234
  Synthetic Construct

SEQ ID NO: 475 - DNA, 18 bp, Artificial Sequence
  Synthetic Construct
agtgacagttactggagc

SEQ ID NO: 476 - protein, 6 aa, Artificial Sequence
  Synthetic Construct
SDSYWS

SEQ ID NO: 477 - DNA, 48 bp, Artificial Sequence; identical to SEQ ID NO: 13
  Synthetic Construct

SEQ ID NO: 478 - protein, 16 aa, Artificial Sequence
  Synthetic Construct
YVHKSGDTNYSPSLKS

SEQ ID NO: 479 - DNA, 72 bp, Artificial Sequence; identical to SEQ ID NO: 15
  Synthetic Construct

SEQ ID NO: 480 - protein, 24 aa, Artificial Sequence
  Synthetic Construct
TLHGRRIYGIVAFNEWFTYFYMDV

SEQ ID NO: 481 - DNA, 693 bp, Artificial Sequence; identical to SEQ ID NO: 1
  Synthetic Construct

SEQ ID NO: 482 - protein, 230 aa, Artificial Sequence; identical to SEQ ID NO: 2
  Synthetic Construct

SEQ ID NO: 483 - DNA, 33 bp, Artificial Sequence; identical to SEQ ID NO: 3
  Synthetic Construct

SEQ ID NO: 484 - protein, 11 aa, Artificial Sequence
  Synthetic Construct
GEKSLGSRAVQ

SEQ ID NO: 485 - DNA, 21 bp, Artificial Sequence
  Synthetic Construct
aataatcaggaccggccctca

SEQ ID NO: 486 - protein, 7 aa, Artificial Sequence
  Synthetic Construct
NNQDRPS

SEQ ID NO: 487 - DNA, 36 bp, Artificial Sequence; identical to SEQ ID NO: 7
  Synthetic Construct

SEQ ID NO: 488 - protein, 12 aa, Artificial Sequence
  Synthetic Construct
HIWDSRVPTKWV

SEQ ID NO: 489 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaaccgccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcgtctattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 490 - protein, 481 aa, Artificial Sequence
  Synthetic Construct
MMSFVSLLLVGILFHATQAQMQLQESGPGLVKPSETLSLTCSVSGASISDSYWSWIRQPPGKGLEWIGYVHKSGDTNYSPSLKSRVNLSLDTSKNQVSLSLVAATAADSGVYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 491 - DNA, 18 bp, Artificial Sequence
  Synthetic Construct
agtgacagttactggagc

SEQ ID NO: 492 - protein, 6 aa, Artificial Sequence
  Synthetic Construct
SDSYWS

SEQ ID NO: 493 - DNA, 48 bp, Artificial Sequence; identical to SEQ ID NO: 13
  Synthetic Construct

SEQ ID NO: 494 - protein, 16 aa, Artificial Sequence
  Synthetic Construct
YVHKSGDTNYSPSLKS

SEQ ID NO: 495 - DNA, 72 bp, Artificial Sequence; identical to SEQ ID NO: 15
  Synthetic Construct

SEQ ID NO: 496 - protein, 24 aa, Artificial Sequence
  Synthetic Construct
TLHGRRIYGIVAFNEWFTYFYMDV

SEQ ID NO: 497 - DNA, 693 bp, Artificial Sequence
  Synthetic Construct
atgatgtcctttgtctctctgctcctggttggcatcctattccatgccacccaggccccctccatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 498 - protein, 230 aa, Artificial Sequence
  Synthetic Construct
MMSFVSLLLVGILFHATQAPSISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 499 - DNA, 33 bp, Artificial Sequence; identical to SEQ ID NO: 3
  Synthetic Construct

SEQ ID NO: 500 - protein, 11 aa, Artificial Sequence
  Synthetic Construct
GEKSLGSRAVQ

SEQ ID NO: 501 - DNA, 21 bp, Artificial Sequence
  Synthetic Construct
aataatcaggaccggccctca

SEQ ID NO: 502 - protein, 7 aa, Artificial Sequence
  Synthetic Construct
NNQDRPS

SEQ ID NO: 503 - DNA, 36 bp, Artificial Sequence; identical to SEQ ID NO: 7
  Synthetic Construct

SEQ ID NO: 504 - protein, 12 aa, Artificial Sequence
  Synthetic Construct
HIWDSRVPTKWV

SEQ ID NO: 505 - DNA, 1446 bp, Artificial Sequence; identical to SEQ ID NO: 25
  Synthetic Construct

SEQ ID NO: 506 - protein, 481 aa, Artificial Sequence; identical to SEQ ID NO: 26
  Synthetic Construct

SEQ ID NO: 507 - DNA, 18 bp, Artificial Sequence
  Synthetic Construct
agtgacagttactggagc

SEQ ID NO: 508 - protein, 6 aa, Artificial Sequence
  Synthetic Construct
SDSYWS

SEQ ID NO: 509 - DNA, 48 bp, Artificial Sequence; identical to SEQ ID NO: 13
  Synthetic Construct

SEQ ID NO: 510 - protein, 16 aa, Artificial Sequence
  Synthetic Construct
YVHKSGDTNYSPSLKS

SEQ ID NO: 511 - DNA, 72 bp, Artificial Sequence; identical to SEQ ID NO: 15
  Synthetic Construct

SEQ ID NO: 512 - protein, 24 aa, Artificial Sequence
  Synthetic Construct
TLHGRRIYGIVAFNEWFTYFYMDV

SEQ ID NO: 513 - DNA, 693 bp, Artificial Sequence
  Synthetic Construct
atgatgtcctttgtctctctgctcctggttggcatcctattccatgccacccaggcctccgatatatctgtggccccaggacagacggccaggatttcctgtggggaaaagagccttggaagtagagctgtacaatggtatcaacagagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggaaagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 514 - protein, 230 aa, Artificial Sequence
  Synthetic Construct
MMSFVSLLLVGILFHATQASDISVAPGQTARISCGEKSLGSRAVQWYQQRAGQAPSLIIYNNQDRPSGIPERFSGSPDSPFGTTATLTITSVEAGDEADYYCHIWESRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 515 - DNA, 33 bp, Artificial Sequence; identical to SEQ ID NO: 3
  Synthetic Construct

SEQ ID NO: 516 - protein, 11 aa, Artificial Sequence
  Synthetic Construct
GEKSLGSRAVQ

SEQ ID NO: 517 - DNA, 21 bp, Artificial Sequence
  Synthetic Construct
aataatcaggaccggccctca

SEQ ID NO: 518 - protein, 7 aa, Artificial Sequence
  Synthetic Construct
NNQDRPS

SEQ ID NO: 519 - DNA, 36 bp, Artificial Sequence; identical to SEQ ID NO: 151
  Synthetic Construct

SEQ ID NO: 520 - protein, 12 aa, Artificial Sequence
  Synthetic Construct
HIWESRVPTKWV

SEQ ID NO: 521 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggctcaacaaattacagcccctccctcaagagtcgagtcaacttgtcgttagacacgtccaaaaatcagttctccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 522 - protein, 481 aa, Artificial Sequence
  Synthetic Construct
MMSFVSLLLVGILFHATQAQMQLQESGPGLVKPSETLSLTCSVSGASISDSYWSWIRRSPGKGLEWIGYVHKSGSTNYSPSLKSRVNLSLDTSKNQFSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 523 - DNA, 18 bp, Artificial Sequence
  Synthetic Construct
agtgacagttactggagc

SEQ ID NO: 524 - protein, 6 aa, Artificial Sequence
  Synthetic Construct
SDSYWS

SEQ ID NO: 525 - DNA, 48 bp, Artificial Sequence; identical to SEQ ID NO: 285
  Synthetic Construct

SEQ ID NO: 526 - protein, 16 aa, Artificial Sequence
  Synthetic Construct
YVHKSGSTNYSPSLKS

SEQ ID NO: 527 - DNA, 72 bp, Artificial Sequence; identical to SEQ ID NO: 15
  Synthetic Construct

SEQ ID NO: 528 - protein, 24 aa, Artificial Sequence
  Synthetic Construct
TLHGRRIYGIVAFNEWFTYFYMDV

SEQ ID NO: 529 - DNA, 693 bp, Artificial Sequence
  Synthetic Construct
atgatgtcctttgtctctctgctcctggttggcatcctattccatgccacccaggcctccgatatatctgtggccccaggacagacggccaggatttcctgtggggaaaagagccttggaagtagagctgtacaatggtatcaacagagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 530 - protein, 230 aa, Artificial Sequence
  Synthetic Construct
MMSFVSLLLVGILFHATQASDISVAPGQTARISCGEKSLGSRAVQWYQQRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 531 - DNA, 33 bp, Artificial Sequence; identical to SEQ ID NO: 3
  Synthetic Construct

SEQ ID NO: 532 - protein, 11 aa, Artificial Sequence
  Synthetic Construct
GEKSLGSRAVQ

SEQ ID NO: 533 - DNA, 21 bp, Artificial Sequence
  Synthetic Construct
aataatcaggaccggccctca

SEQ ID NO: 534 - protein, 7 aa, Artificial Sequence
  Synthetic Construct
NNQDRPS

SEQ ID NO: 535 - DNA, 36 bp, Artificial Sequence; identical to SEQ ID NO: 7
  Synthetic Construct

SEQ ID NO: 536 - protein, 12 aa, Artificial Sequence
  Synthetic Construct
HIWDSRVPTKWV

SEQ ID NO: 537 - DNA, 1446 bp, Artificial Sequence; identical to SEQ ID NO: 377
  Synthetic Construct

SEQ ID NO: 538 - protein, 481 aa, Artificial Sequence; identical to SEQ ID NO: 378
  Synthetic Construct

SEQ ID NO: 539 - DNA, 18 bp, Artificial Sequence
  Synthetic Construct
agtgacagttactggagc

SEQ ID NO: 540 - protein, 6 aa, Artificial Sequence
  Synthetic Construct
SDSYWS

SEQ ID NO: 541 - DNA, 48 bp, Artificial Sequence; identical to SEQ ID NO: 13
  Synthetic Construct

SEQ ID NO: 542 - protein, 16 aa, Artificial Sequence
  Synthetic Construct
YVHKSGDTNYSPSLKS

SEQ ID NO: 543 - DNA, 72 bp, Artificial Sequence; identical to SEQ ID NO: 15
  Synthetic Construct

SEQ ID NO: 544 - protein, 24 aa, Artificial Sequence
  Synthetic Construct
TLHGRRIYGIVAFNEWFTYFYMDV

SEQ ID NO: 545 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccggagtcgaagccggggatgaggccgactattactgtcatatatgggatagtagagttcccaccaaatgggtcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 546 - protein, 230 aa, Artificial Sequence
  Synthetic Construct
MMSFVSLLLVGILFHATQASDISVAPGETARISCGEKSLGSRAVQWYQHRAGQAPSLIIYNNQDRPSGIPERFSGSPDSPFGTTATLTITGVEAGDEADYYCHIWDSRVPTKWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 547 - DNA, 33 bp, Artificial Sequence; identical to SEQ ID NO: 3
  Synthetic Construct

SEQ ID NO: 548 - protein, 11 aa, Artificial Sequence
  Synthetic Construct
GEKSLGSRAVQ

SEQ ID NO: 549 - DNA, 21 bp, Artificial Sequence
  Synthetic Construct
aataatcaggaccggccctca

SEQ ID NO: 550 - protein, 7 aa, Artificial Sequence
  Synthetic Construct
NNQDRPS

SEQ ID NO: 551 - DNA, 36 bp, Artificial Sequence; identical to SEQ ID NO: 7
  Synthetic Construct

SEQ ID NO: 552 - protein, 12 aa, Artificial Sequence
  Synthetic Construct
HIWDSRVPTKWV

SEQ ID NO: 553 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggccgccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 554 - protein, 481 aa, Artificial Sequence
  Synthetic Construct
MMSFVSLLLVGILFHATQAQMQLQESGPGLVKPSETLSLTCSVSGASISDSYWSWIRRPPGKGLEWIGYVHKSGDTNYSPSLKSRVNLSLDTSKNQVSLSLSAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 555 - DNA, 18 bp, Artificial Sequence
  Synthetic Construct
agtgacagttactggagc

SEQ ID NO: 556 - protein, 6 aa, Artificial Sequence
  Synthetic Construct
SDSYWS

SEQ ID NO: 557 - DNA, 48 bp, Artificial Sequence; identical to SEQ ID NO: 13
  Synthetic Construct

SEQ ID NO: 558 - protein, 16 aa, Artificial Sequence
  Synthetic Construct
YVHKSGDTNYSPSLKS

SEQ ID NO: 559 - DNA, 72 bp, Artificial Sequence; identical to SEQ ID NO: 15
  Synthetic Construct

SEQ ID NO: 560 - protein, 24 aa, Artificial Sequence
  Synthetic Construct
TLHGRRIYGIVAFNEWFTYFYMDV

SEQ ID NO: 561 - DNA, 693 bp, Artificial Sequence; identical to SEQ ID NO: 1
  Synthetic Construct

SEQ ID NO: 562 - protein, 230 aa, Artificial Sequence; identical to SEQ ID NO: 2
  Synthetic Construct

SEQ ID NO: 563 - DNA, 33 bp, Artificial Sequence; identical to SEQ ID NO: 3
  Synthetic Construct

SEQ ID NO: 564 - protein, 11 aa, Artificial Sequence
  Synthetic Construct
GEKSLGSRAVQ

SEQ ID NO: 565 - DNA, 21 bp, Artificial Sequence
  Synthetic Construct
aataatcaggaccggccctca

SEQ ID NO: 566 - protein, 7 aa, Artificial Sequence
  Synthetic Construct
NNQDRPS

SEQ ID NO: 567 - DNA, 36 bp, Artificial Sequence; identical to SEQ ID NO: 7
  Synthetic Construct

SEQ ID NO: 568 - protein, 12 aa, Artificial Sequence
  Synthetic Construct
HIWDSRVPTKWV

SEQ ID NO: 569 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctaggtggcagcaggggaacgtcttctcatgctccgtgctccatgaggctctgcactcccactacacgcagaagagcctctccctgtctccgggtaaatga

SEQ ID NO: 570 - protein, 481 aa, Artificial Sequence; identical to SEQ ID NO: 26
  Synthetic Construct

SEQ ID NO: 571 - DNA, 18 bp, Artificial Sequence
  Synthetic Construct
agtgacagttactggagc

SEQ ID NO: 572 - protein, 6 aa, Artificial Sequence
  Synthetic Construct
SDSYWS

SEQ ID NO: 573 - DNA, 48 bp, Artificial Sequence; identical to SEQ ID NO: 13
  Synthetic Construct

SEQ ID NO: 574 - protein, 16 aa, Artificial Sequence
  Synthetic Construct
YVHKSGDTNYSPSLKS

SEQ ID NO: 575 - DNA, 72 bp, Artificial Sequence; identical to SEQ ID NO: 15
  Synthetic Construct

SEQ ID NO: 576 - protein, 24 aa, Artificial Sequence
  Synthetic Construct
TLHGRRIYGIVAFNEWFTYFYMDV

SEQ ID NO: 577 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccggatttgggaccacggccaccctgaccatcaccagtgtcgaagccggggatgaggccgactattactgtcatatatgggatagtagagttcccaccaaatgggtcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 578 - protein, 230 aa, Artificial Sequence
  Synthetic Construct
MMSFVSLLLVGILFHATQASDISVAPGETARISCGEKSLGSRAVQWYQHRAGQAPSLIIYNNQDRPSGIPERFSGSPDSGFGTTATLTITSVEAGDEADYYCHIWDSRVPTKWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 579 - DNA, 33 bp, Artificial Sequence; identical to SEQ ID NO: 3
  Synthetic Construct

SEQ ID NO: 580 - protein, 11 aa, Artificial Sequence
  Synthetic Construct
GEKSLGSRAVQ

SEQ ID NO: 581 - DNA, 21 bp, Artificial Sequence
  Synthetic Construct
aataatcaggaccggccctca

SEQ ID NO: 582 - protein, 7 aa, Artificial Sequence
  Synthetic Construct
NNQDRPS

SEQ ID NO: 583 - DNA, 36 bp, Artificial Sequence; identical to SEQ ID NO: 7
  Synthetic Construct

SEQ ID NO: 584 - protein, 12 aa, Artificial Sequence
  Synthetic Construct
HIWDSRVPTKWV

SEQ ID NO: 585 - DNA, 1446 bp, Artificial Sequence; identical to SEQ ID NO: 25
  Synthetic Construct

SEQ ID NO: 586 - protein, 481 aa, Artificial Sequence; identical to SEQ ID NO: 26
  Synthetic Construct

SEQ ID NO: 587 - DNA, 18 bp, Artificial Sequence
  Synthetic Construct
agtgacagttactggagc

SEQ ID NO: 588 - protein, 6 aa, Artificial Sequence
  Synthetic Construct
SDSYWS

SEQ ID NO: 589 - DNA, 48 bp, Artificial Sequence; identical to SEQ ID NO: 13
  Synthetic Construct

SEQ ID NO: 590 - protein, 16 aa, Artificial Sequence
  Synthetic Construct
YVHKSGDTNYSPSLKS

SEQ ID NO: 591 - DNA, 72 bp, Artificial Sequence; identical to SEQ ID NO: 15
  Synthetic Construct

SEQ ID NO: 592 - protein, 24 aa, Artificial Sequence
  Synthetic Construct
TLHGRRIYGIVAFNEWFTYFYMDV

SEQ ID NO: 593 - DNA, 693 bp, Artificial Sequence; identical to SEQ ID NO: 113
  Synthetic Construct

SEQ ID NO: 594 - protein, 230 aa, Artificial Sequence; identical to SEQ ID NO: 114
  Synthetic Construct

SEQ ID NO: 595 - DNA, 33 bp, Artificial Sequence; identical to SEQ ID NO: 3
  Synthetic Construct

SEQ ID NO: 596 - protein, 11 aa, Artificial Sequence
  Synthetic Construct
GEKSLGSRAVQ

SEQ ID NO: 597 - DNA, 21 bp, Artificial Sequence
  Synthetic Construct
aataatcaggaccggccctca

SEQ ID NO: 598 - protein, 7 aa, Artificial Sequence
  Synthetic Construct
NNQDRPS

SEQ ID NO: 599 - DNA, 36 bp, Artificial Sequence; identical to SEQ ID NO: 7
  Synthetic Construct

SEQ ID NO: 600 - protein, 12 aa, Artificial Sequence
  Synthetic Construct
HIWDSRVPTKWV

SEQ ID NO: 601 - DNA, 1446 bp, Artificial Sequence; identical to SEQ ID NO: 185
  Synthetic Construct

SEQ ID NO: 602 - protein, 481 aa, Artificial Sequence; identical to SEQ ID NO: 186
  Synthetic Construct

SEQ ID NO: 603 - DNA, 18 bp, Artificial Sequence
  Synthetic Construct
agtgacagttactggagc

SEQ ID NO: 604 - protein, 6 aa, Artificial Sequence
  Synthetic Construct
SDSYWS

SEQ ID NO: 605 - DNA, 48 bp, Artificial Sequence; identical to SEQ ID NO: 13
  Synthetic Construct

SEQ ID NO: 606 - protein, 16 aa, Artificial Sequence
  Synthetic Construct
YVHKSGDTNYSPSLKS

SEQ ID NO: 607 - DNA, 72 bp, Artificial Sequence; identical to SEQ ID NO: 15
  Synthetic Construct

SEQ ID NO: 608 - protein, 24 aa, Artificial Sequence
  Synthetic Construct
TLHGRRIYGIVAFNEWFTYFYMDV

SEQ ID NO: 609 - DNA, 693 bp, Artificial Sequence; identical to SEQ ID NO: 113
  Synthetic Construct

SEQ ID NO: 610 - protein, 230 aa, Artificial Sequence; identical to SEQ ID NO: 114
  Synthetic Construct

SEQ ID NO: 611 - DNA, 33 bp, Artificial Sequence; identical to SEQ ID NO: 3
  Synthetic Construct

SEQ ID NO: 612 - protein, 11 aa, Artificial Sequence
  Synthetic Construct
GEKSLGSRAVQ

SEQ ID NO: 613 - DNA, 21 bp, Artificial Sequence
  Synthetic Construct
aataatcaggaccggccctca

SEQ ID NO: 614 - protein, 7 aa, Artificial Sequence
  Synthetic Construct
NNQDRPS

SEQ ID NO: 615 - DNA, 36 bp, Artificial Sequence; identical to SEQ ID NO: 7
  Synthetic Construct

SEQ ID NO: 616 - protein, 12 aa, Artificial Sequence
  Synthetic Construct
HIWDSRVPTKWV

SEQ ID NO: 617 - DNA, 1446 bp, Artificial Sequence; identical to SEQ ID NO: 249
  Synthetic Construct

SEQ ID NO: 618 - protein, 481 aa, Artificial Sequence; identical to SEQ ID NO: 250
  Synthetic Construct

SEQ ID NO: 619 - DNA, 18 bp, Artificial Sequence
  Synthetic Construct
agtgacagttactggagc

SEQ ID NO: 620 - protein, 6 aa, Artificial Sequence
  Synthetic Construct
SDSYWS

SEQ ID NO: 621 - DNA, 48 bp, Artificial Sequence; identical to SEQ ID NO: 13
  Synthetic Construct

SEQ ID NO: 622 - protein, 16 aa, Artificial Sequence
  Synthetic Construct
YVHKSGDTNYSPSLKS

SEQ ID NO: 623 - DNA, 72 bp, Artificial Sequence; identical to SEQ ID NO: 15
  Synthetic Construct

SEQ ID NO: 624 - protein, 24 aa, Artificial Sequence
  Synthetic Construct
TLHGRRIYGIVAFNEWFTYFYMDV

SEQ ID NO: 625 - DNA, 693 bp, Artificial Sequence; identical to SEQ ID NO: 113
  Synthetic Construct

SEQ ID NO: 626 - protein, 230 aa, Artificial Sequence; identical to SEQ ID NO: 114
  Synthetic Construct

SEQ ID NO: 627 - DNA, 33 bp, Artificial Sequence; identical to SEQ ID NO: 3
  Synthetic Construct

SEQ ID NO: 628 - protein, 11 aa, Artificial Sequence
  Synthetic Construct
GEKSLGSRAVQ

SEQ ID NO: 629 - DNA, 21 bp, Artificial Sequence
  Synthetic Construct
aataatcaggaccggccctca

SEQ ID NO: 630 - protein, 7 aa, Artificial Sequence
  Synthetic Construct
NNQDRPS

SEQ ID NO: 631 - DNA, 36 bp, Artificial Sequence; identical to SEQ ID NO: 7
  Synthetic Construct

SEQ ID NO: 632 - protein, 12 aa, Artificial Sequence
  Synthetic Construct
HIWDSRVPTKWV

SEQ ID NO: 633 - DNA, 1446 bp, Artificial Sequence; identical to SEQ ID NO: 345
  Synthetic Construct

SEQ ID NO: 634 - protein, 481 aa, Artificial Sequence; identical to SEQ ID NO: 346
  Synthetic Construct

SEQ ID NO: 635 - DNA, 18 bp, Artificial Sequence
  Synthetic Construct
agtgacagttactggagc

SEQ ID NO: 636 - protein, 6 aa, Artificial Sequence
  Synthetic Construct
SDSYWS

SEQ ID NO: 637 - DNA, 48 bp, Artificial Sequence; identical to SEQ ID NO: 13
  Synthetic Construct

SEQ ID NO: 638 - protein, 16 aa, Artificial Sequence
  Synthetic Construct
YVHKSGDTNYSPSLKS

SEQ ID NO: 639 - DNA, 72 bp, Artificial Sequence; identical to SEQ ID NO: 15
  Synthetic Construct

SEQ ID NO: 640 - protein, 24 aa, Artificial Sequence
  Synthetic Construct
TLHGRRIYGIVAFNEWFTYFYMDV

SEQ ID NO: 641 - DNA, 693 bp, Artificial Sequence; identical to SEQ ID NO: 161
  Synthetic Construct

SEQ ID NO: 642 - protein, 230 aa, Artificial Sequence; identical to SEQ ID NO: 162
  Synthetic Construct

SEQ ID NO: 643 - DNA, 33 bp, Artificial Sequence; identical to SEQ ID NO: 3
  Synthetic Construct

SEQ ID NO: 644 - protein, 11 aa, Artificial Sequence
  Synthetic Construct
GEKSLGSRAVQ

SEQ ID NO: 645 - DNA, 21 bp, Artificial Sequence
  Synthetic Construct
aataatcaggaccggccctca

SEQ ID NO: 646 - protein, 7 aa, Artificial Sequence
  Synthetic Construct
NNQDRPS

SEQ ID NO: 647 - DNA, 36 bp, Artificial Sequence; identical to SEQ ID NO: 7
  Synthetic Construct

SEQ ID NO: 648 - protein, 12 aa, Artificial Sequence
  Synthetic Construct
HIWDSRVPTKWV

SEQ ID NO: 649 - DNA, 1446 bp, Artificial Sequence; identical to SEQ ID NO: 185
  Synthetic Construct

SEQ ID NO: 650 - protein, 481 aa, Artificial Sequence; identical to SEQ ID NO: 186
  Synthetic Construct

SEQ ID NO: 651 - DNA, 18 bp, Artificial Sequence
  Synthetic Construct
agtgacagttactggagc

SEQ ID NO: 652 - protein, 6 aa, Artificial Sequence
  Synthetic Construct
SDSYWS

SEQ ID NO: 653 - DNA, 48 bp, Artificial Sequence; identical to SEQ ID NO: 13
  Synthetic Construct

SEQ ID NO: 654 - protein, 16 aa, Artificial Sequence
  Synthetic Construct
YVHKSGDTNYSPSLKS

SEQ ID NO: 655 - DNA, 72 bp, Artificial Sequence; identical to SEQ ID NO: 15
  Synthetic Construct

SEQ ID NO: 656 - protein, 24 aa, Artificial Sequence
  Synthetic Construct
TLHGRRIYGIVAFNEWFTYFYMDV

SEQ ID NO: 657 - DNA, 693 bp, Artificial Sequence; identical to SEQ ID NO: 161
  Synthetic Construct

SEQ ID NO: 658 - protein, 230 aa, Artificial Sequence; identical to SEQ ID NO: 162
  Synthetic Construct

SEQ ID NO: 659 - DNA, 33 bp, Artificial Sequence; identical to SEQ ID NO: 3
  Synthetic Construct

SEQ ID NO: 660 - protein, 11 aa, Artificial Sequence
  Synthetic Construct
GEKSLGSRAVQ

SEQ ID NO: 661 - DNA, 21 bp, Artificial Sequence
  Synthetic Construct
aataatcaggaccggccctca

SEQ ID NO: 662 - protein, 7 aa, Artificial Sequence
  Synthetic Construct
NNQDRPS

SEQ ID NO: 663 - DNA, 36 bp, Artificial Sequence; identical to SEQ ID NO: 7
  Synthetic Construct

SEQ ID NO: 664 - protein, 12 aa, Artificial Sequence
  Synthetic Construct
HIWDSRVPTKWV

SEQ ID NO: 665 - DNA, 1446 bp, Artificial Sequence; identical to SEQ ID NO: 249
  Synthetic Construct

SEQ ID NO: 666 - protein, 481 aa, Artificial Sequence; identical to SEQ ID NO: 250
  Synthetic Construct

SEQ ID NO: 667 - DNA, 18 bp, Artificial Sequence
  Synthetic Construct
agtgacagttactggagc

SEQ ID NO: 668 - protein, 6 aa, Artificial Sequence
  Synthetic Construct
SDSYWS

SEQ ID NO: 669 - DNA, 48 bp, Artificial Sequence; identical to SEQ ID NO: 13
  Synthetic Construct

SEQ ID NO: 670 - protein, 16 aa, Artificial Sequence
  Synthetic Construct
YVHKSGDTNYSPSLKS

SEQ ID NO: 671 - DNA, 72 bp, Artificial Sequence; identical to SEQ ID NO: 15
  Synthetic Construct

SEQ ID NO: 672 - protein, 24 aa, Artificial Sequence
  Synthetic Construct
TLHGRRIYGIVAFNEWFTYFYMDV

SEQ ID NO: 673 - DNA, 693 bp, Artificial Sequence; identical to SEQ ID NO: 161
  Synthetic Construct

SEQ ID NO: 674 - protein, 230 aa, Artificial Sequence; identical to SEQ ID NO: 162
  Synthetic Construct

SEQ ID NO: 675 - DNA, 33 bp, Artificial Sequence; identical to SEQ ID NO: 3
  Synthetic Construct

SEQ ID NO: 676 - protein, 11 aa, Artificial Sequence
  Synthetic Construct
GEKSLGSRAVQ

SEQ ID NO: 677 - DNA, 21 bp, Artificial Sequence
  Synthetic Construct
aataatcaggaccggccctca

SEQ ID NO: 678 - protein, 7 aa, Artificial Sequence
  Synthetic Construct
NNQDRPS

SEQ ID NO: 679 - DNA, 36 bp, Artificial Sequence; identical to SEQ ID NO: 7
  Synthetic Construct

SEQ ID NO: 680 - protein, 12 aa, Artificial Sequence
  Synthetic Construct
HIWDSRVPTKWV

SEQ ID NO: 681 - DNA, 1446 bp, Artificial Sequence; identical to SEQ ID NO: 345
  Synthetic Construct

SEQ ID NO: 682 - protein, 481 aa, Artificial Sequence; identical to SEQ ID NO: 346
  Synthetic Construct

SEQ ID NO: 683 - DNA, 18 bp, Artificial Sequence
  Synthetic Construct
agtgacagttactggagc

SEQ ID NO: 684 - protein, 6 aa, Artificial Sequence
  Synthetic Construct
SDSYWS

SEQ ID NO: 685 - DNA, 48 bp, Artificial Sequence; identical to SEQ ID NO: 13
  Synthetic Construct

SEQ ID NO: 686 - protein, 16 aa, Artificial Sequence
  Synthetic Construct
YVHKSGDTNYSPSLKS

SEQ ID NO: 687 - DNA, 72 bp, Artificial Sequence; identical to SEQ ID NO: 15
  Synthetic Construct

SEQ ID NO: 688 - protein, 24 aa, Artificial Sequence
  Synthetic Construct
TLHGRRIYGIVAFNEWFTYFYMDV

SEQ ID NO: 689 - DNA, 693 bp, Artificial Sequence; identical to SEQ ID NO: 1
  Synthetic Construct

SEQ ID NO: 690 - protein, 230 aa, Artificial Sequence; identical to SEQ ID NO: 2
  Synthetic Construct

SEQ ID NO: 691 - DNA, 33 bp, Artificial Sequence; identical to SEQ ID NO: 3
  Synthetic Construct

SEQ ID NO: 692 - protein, 11 aa, Artificial Sequence
  Synthetic Construct
GEKSLGSRAVQ

SEQ ID NO: 693 - DNA, 21 bp, Artificial Sequence
  Synthetic Construct
aataatcaggaccggccctca

SEQ ID NO: 694 - protein, 7 aa, Artificial Sequence
  Synthetic Construct
NNQDRPS

SEQ ID NO: 695 - DNA, 36 bp, Artificial Sequence; identical to SEQ ID NO: 7
  Synthetic Construct

SEQ ID NO: 696 - protein, 12 aa, Artificial Sequence
  Synthetic Construct
HIWDSRVPTKWV

SEQ ID NO: 697 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgggtccataagtgacagttactggagctggatccggcggccgccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 698 - protein, 481 aa, Artificial Sequence
  Synthetic Construct
MMSFVSLLLVGILFHATQAQMQLQESGPGLVKPSETLSLTCSVSGGSISDSYWSWIRRPPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 699 - DNA, 18 bp, Artificial Sequence
  Synthetic Construct
agtgacagttactggagc

SEQ ID NO: 700 - protein, 6 aa, Artificial Sequence
  Synthetic Construct
SDSYWS

SEQ ID NO: 701 - DNA, 48 bp, Artificial Sequence; identical to SEQ ID NO: 13
  Synthetic Construct

SEQ ID NO: 702 - protein, 16 aa, Artificial Sequence
  Synthetic Construct
YVHKSGDTNYSPSLKS

SEQ ID NO: 703 - DNA, 72 bp, Artificial Sequence; identical to SEQ ID NO: 15
  Synthetic Construct

SEQ ID NO: 704 - protein, 24 aa, Artificial Sequence
  Synthetic Construct
TLHGRRIYGIVAFNEWFTYFYMDV

SEQ ID NO: 705 - DNA, 693 bp, Artificial Sequence; identical to SEQ ID NO: 1
  Synthetic Construct

SEQ ID NO: 706 - protein, 230 aa, Artificial Sequence; identical to SEQ ID NO: 2
  Synthetic Construct

SEQ ID NO: 707 - DNA, 33 bp, Artificial Sequence; identical to SEQ ID NO: 3
  Synthetic Construct

SEQ ID NO: 708 - protein, 11 aa, Artificial Sequence
  Synthetic Construct
GEKSLGSRAVQ

SEQ ID NO: 709 - DNA, 21 bp, Artificial Sequence
  Synthetic Construct
aataatcaggaccggccctca

SEQ ID NO: 710 - protein, 7 aa, Artificial Sequence
  Synthetic Construct
NNQDRPS

SEQ ID NO: 711 - DNA, 36 bp, Artificial Sequence; identical to SEQ ID NO: 7
  Synthetic Construct

SEQ ID NO: 712 - protein, 12 aa, Artificial Sequence
  Synthetic Construct
HIWDSRVPTKWV

SEQ ID NO: 713 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgggtccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 714 - protein, 481 aa, Artificial Sequence
  Synthetic Construct
MMSFVSLLLVGILFHATQAQMQLQESGPGLVKPSETLSLTCSVSGGSISDSYWSWIRRSPGKGLEWIGYVHKSGDTNYSPSLKSRVNLSLDTSKNQVSLSLSAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 715 - DNA, 18 bp, Artificial Sequence
  Synthetic Construct
agtgacagttactggagc

SEQ ID NO: 716 - protein, 6 aa, Artificial Sequence
  Synthetic Construct
SDSYWS

SEQ ID NO: 717 - DNA, 48 bp, Artificial Sequence; identical to SEQ ID NO: 13
  Synthetic Construct

SEQ ID NO: 718 - protein, 16 aa, Artificial Sequence
  Synthetic Construct
YVHKSGDTNYSPSLKS

SEQ ID NO: 719 - DNA, 72 bp, Artificial Sequence; identical to SEQ ID NO: 15
  Synthetic Construct

SEQ ID NO: 720 - protein, 24 aa, Artificial Sequence
  Synthetic Construct
TLHGRRIYGIVAFNEWFTYFYMDV

SEQ ID NO: 721 - DNA, 693 bp, Artificial Sequence; identical to SEQ ID NO: 1
  Synthetic Construct

SEQ ID NO: 722 - protein, 230 aa, Artificial Sequence; identical to SEQ ID NO: 2
  Synthetic Construct

SEQ ID NO: 723 - DNA, 33 bp, Artificial Sequence; identical to SEQ ID NO: 3
  Synthetic Construct

SEQ ID NO: 724 - protein, 11 aa, Artificial Sequence
  Synthetic Construct
GEKSLGSRAVQ

SEQ ID NO: 725 - DNA, 21 bp, Artificial Sequence
  Synthetic Construct
aataatcaggaccggccctca

SEQ ID NO: 726 - protein, 7 aa, Artificial Sequence
  Synthetic Construct
NNQDRPS

SEQ ID NO: 727 - DNA, 36 bp, Artificial Sequence; identical to SEQ ID NO: 7
  Synthetic Construct

SEQ ID NO: 728 - protein, 12 aa, Artificial Sequence
  Synthetic Construct
HIWDSRVPTKWV

SEQ ID NO: 729 - DNA, 1446 bp, Artificial Sequence; identical to SEQ ID NO: 553
  Synthetic Construct

SEQ ID NO: 730 - protein, 481 aa, Artificial Sequence; identical to SEQ ID NO: 554
  Synthetic Construct

SEQ ID NO: 731 - DNA, 18 bp, Artificial Sequence
  Synthetic Construct
agtgacagttactggagc

SEQ ID NO: 732 - protein, 6 aa, Artificial Sequence
  Synthetic Construct
SDSYWS

SEQ ID NO: 733 - DNA, 48 bp, Artificial Sequence; identical to SEQ ID NO: 13
  Synthetic Construct

SEQ ID NO: 734 - protein, 16 aa, Artificial Sequence
  Synthetic Construct
YVHKSGDTNYSPSLKS

SEQ ID NO: 735 - DNA, 72 bp, Artificial Sequence; identical to SEQ ID NO: 15
  Synthetic Construct

SEQ ID NO: 736 - protein, 24 aa, Artificial Sequence
  Synthetic Construct
TLHGRRIYGIVAFNEWFTYFYMDV

SEQ ID NO: 737 - DNA, 693 bp, Artificial Sequence; identical to SEQ ID NO: 577
  Synthetic Construct

SEQ ID NO: 738 - protein, 230 aa, Artificial Sequence; identical to SEQ ID NO: 578
  Synthetic Construct

SEQ ID NO: 739 - DNA, 33 bp, Artificial Sequence; identical to SEQ ID NO: 3
  Synthetic Construct

SEQ ID NO: 740 - protein, 11 aa, Artificial Sequence
  Synthetic Construct
GEKSLGSRAVQ

SEQ ID NO: 741 - DNA, 21 bp, Artificial Sequence
  Synthetic Construct
aataatcaggaccggccctca

SEQ ID NO: 742 - protein, 7 aa, Artificial Sequence
  Synthetic Construct
NNQDRPS

SEQ ID NO: 743 - DNA, 36 bp, Artificial Sequence; identical to SEQ ID NO: 7
  Synthetic Construct

SEQ ID NO: 744 - protein, 12 aa, Artificial Sequence
  Synthetic Construct
HIWDSRVPTKWV

SEQ ID NO: 745 - DNA, 1446 bp, Artificial Sequence; identical to SEQ ID NO: 185
  Synthetic Construct

SEQ ID NO: 746 - protein, 481 aa, Artificial Sequence; identical to SEQ ID NO: 186
  Synthetic Construct

SEQ ID NO: 747 - DNA, 18 bp, Artificial Sequence
  Synthetic Construct
agtgacagttactggagc

SEQ ID NO: 748 - protein, 6 aa, Artificial Sequence
  Synthetic Construct
SDSYWS

SEQ ID NO: 749 - DNA, 48 bp, Artificial Sequence; identical to SEQ ID NO: 13
  Synthetic Construct

SEQ ID NO: 750 - protein, 16 aa, Artificial Sequence
  Synthetic Construct
YVHKSGDTNYSPSLKS

SEQ ID NO: 751 - DNA, 72 bp, Artificial Sequence; identical to SEQ ID NO: 15
  Synthetic Construct

SEQ ID NO: 752 - protein, 24 aa, Artificial Sequence
  Synthetic Construct
TLHGRRIYGIVAFNEWFTYFYMDV

SEQ ID NO: 753 - DNA, 693 bp, Artificial Sequence; identical to SEQ ID NO: 577
  Synthetic Construct

SEQ ID NO: 754 - protein, 230 aa, Artificial Sequence; identical to SEQ ID NO: 578
  Synthetic Construct

SEQ ID NO: 755 - DNA, 33 bp, Artificial Sequence; identical to SEQ ID NO: 3
  Synthetic Construct

SEQ ID NO: 756 - protein, 11 aa, Artificial Sequence
  Synthetic Construct
GEKSLGSRAVQ

SEQ ID NO: 757 - DNA, 21 bp, Artificial Sequence
  Synthetic Construct
aataatcaggaccggccctca

SEQ ID NO: 758 - protein, 7 aa, Artificial Sequence
  Synthetic Construct
NNQDRPS

SEQ ID NO: 759 - DNA, 36 bp, Artificial Sequence; identical to SEQ ID NO: 7
  Synthetic Construct

SEQ ID NO: 760 - protein, 12 aa, Artificial Sequence
  Synthetic Construct
HIWDSRVPTKWV

SEQ ID NO: 761 - DNA, 1446 bp, Artificial Sequence; identical to SEQ ID NO: 249
  Synthetic Construct

SEQ ID NO: 762 - protein, 481 aa, Artificial Sequence; identical to SEQ ID NO: 250
  Synthetic Construct

SEQ ID NO: 763 - DNA, 18 bp, Artificial Sequence
  Synthetic Construct
agtgacagttactggagc

SEQ ID NO: 764 - protein, 6 aa, Artificial Sequence
  Synthetic Construct
SDSYWS

SEQ ID NO: 765 - DNA, 48 bp, Artificial Sequence; identical to SEQ ID NO: 13
  Synthetic Construct

SEQ ID NO: 766 - protein, 16 aa, Artificial Sequence
  Synthetic Construct
YVHKSGDTNYSPSLKS

SEQ ID NO: 767 - DNA, 72 bp, Artificial Sequence; identical to SEQ ID NO: 15
  Synthetic Construct

SEQ ID NO: 768 - protein, 24 aa, Artificial Sequence
  Synthetic Construct
TLHGRRIYGIVAFNEWFTYFYMDV

SEQ ID NO: 769 - DNA, 693 bp, Artificial Sequence; identical to SEQ ID NO: 577
  Synthetic Construct

SEQ ID NO: 770 - protein, 230 aa, Artificial Sequence; identical to SEQ ID NO: 578
  Synthetic Construct

SEQ ID NO: 771 - DNA, 33 bp, Artificial Sequence; identical to SEQ ID NO: 3
  Synthetic Construct

SEQ ID NO: 772 - protein, 11 aa, Artificial Sequence
  Synthetic Construct
GEKSLGSRAVQ

SEQ ID NO: 773 - DNA, 21 bp, Artificial Sequence
  Synthetic Construct
aataatcaggaccggccctca

SEQ ID NO: 774 - protein, 7 aa, Artificial Sequence
  Synthetic Construct
NNQDRPS

SEQ ID NO: 775 - DNA, 36 bp, Artificial Sequence; identical to SEQ ID NO: 7
  Synthetic Construct

SEQ ID NO: 776 - protein, 12 aa, Artificial Sequence
  Synthetic Construct
HIWDSRVPTKWV

SEQ ID NO: 777 - DNA, 1446 bp, Artificial Sequence; identical to SEQ ID NO: 345
  Synthetic Construct

SEQ ID NO: 778 - protein, 481 aa, Artificial Sequence; identical to SEQ ID NO: 346
  Synthetic Construct

SEQ ID NO: 779 - DNA, 18 bp, Artificial Sequence
  Synthetic Construct
agtgacagttactggagc

SEQ ID NO: 780 - protein, 6 aa, Artificial Sequence
  Synthetic Construct
SDSYWS

SEQ ID NO: 781 - DNA, 48 bp, Artificial Sequence; identical to SEQ ID NO: 13
  Synthetic Construct

SEQ ID NO: 782 - protein, 16 aa, Artificial Sequence
  Synthetic Construct
YVHKSGDTNYSPSLKS

SEQ ID NO: 783 - DNA, 72 bp, Artificial Sequence; identical to SEQ ID NO: 15
  Synthetic Construct

SEQ ID NO: 784 - protein, 24 aa, Artificial Sequence
  Synthetic Construct
TLHGRRIYGIVAFNEWFTYFYMDV

SEQ ID NO: 785 - DNA, 693 bp, Artificial Sequence; identical to SEQ ID NO: 113
  Synthetic Construct

SEQ ID NO: 786 - protein, 230 aa, Artificial Sequence; identical to SEQ ID NO: 114
  Synthetic Construct

SEQ ID NO: 787 - DNA, 33 bp, Artificial Sequence; identical to SEQ ID NO: 3
  Synthetic Construct

SEQ ID NO: 788 - protein, 11 aa, Artificial Sequence
  Synthetic Construct
GEKSLGSRAVQ

SEQ ID NO: 789 - DNA, 21 bp, Artificial Sequence
  Synthetic Construct
aataatcaggaccggccctca

SEQ ID NO: 790 - protein, 7 aa, Artificial Sequence
  Synthetic Construct
NNQDRPS

SEQ ID NO: 791 - DNA, 36 bp, Artificial Sequence; identical to SEQ ID NO: 7
  Synthetic Construct

SEQ ID NO: 792 - protein, 12 aa, Artificial Sequence
  Synthetic Construct
HIWDSRVPTKWV

SEQ ID NO: 793 - DNA, 1446 bp, Artificial Sequence; identical to SEQ ID NO: 697
  Synthetic Construct

SEQ ID NO: 794 - protein, 481 aa, Artificial Sequence; identical to SEQ ID NO: 698
  Synthetic Construct

SEQ ID NO: 795 - DNA, 18 bp, Artificial Sequence
  Synthetic Construct
agtgacagttactggagc

SEQ ID NO: 796 - protein, 6 aa, Artificial Sequence
  Synthetic Construct
SDSYWS

SEQ ID NO: 797 - DNA, 48 bp, Artificial Sequence; identical to SEQ ID NO: 13
  Synthetic Construct

SEQ ID NO: 798 - protein, 16 aa, Artificial Sequence
  Synthetic Construct
YVHKSGDTNYSPSLKS

SEQ ID NO: 799 - DNA, 72 bp, Artificial Sequence; identical to SEQ ID NO: 15
  Synthetic Construct

SEQ ID NO: 800 - protein, 24 aa, Artificial Sequence
  Synthetic Construct
TLHGRRIYGIVAFNEWFTYFYMDV

SEQ ID NO: 801 - DNA, 693 bp, Artificial Sequence; identical to SEQ ID NO: 113
  Synthetic Construct

SEQ ID NO: 802 - protein, 230 aa, Artificial Sequence; identical to SEQ ID NO: 114
  Synthetic Construct

SEQ ID NO: 803 - DNA, 33 bp, Artificial Sequence; identical to SEQ ID NO: 3
  Synthetic Construct

SEQ ID NO: 804 - protein, 11 aa, Artificial Sequence
  Synthetic Construct
GEKSLGSRAVQ

SEQ ID NO: 805 - DNA, 21 bp, Artificial Sequence
  Synthetic Construct
aataatcaggaccggccctca

SEQ ID NO: 806 - protein, 7 aa, Artificial Sequence
  Synthetic Construct
NNQDRPS

SEQ ID NO: 807 - DNA, 36 bp, Artificial Sequence; identical to SEQ ID NO: 7
  Synthetic Construct

SEQ ID NO: 808 - protein, 12 aa, Artificial Sequence
  Synthetic Construct
HIWDSRVPTKWV

SEQ ID NO: 809 - DNA, 1446 bp, Artificial Sequence; identical to SEQ ID NO: 713
  Synthetic Construct

SEQ ID NO: 810 - protein, 481 aa, Artificial Sequence; identical to SEQ ID NO: 714
  Synthetic Construct

SEQ ID NO: 811 - DNA, 18 bp, Artificial Sequence
  Synthetic Construct
agtgacagttactggagc

SEQ ID NO: 812 - protein, 6 aa, Artificial Sequence
  Synthetic Construct
SDSYWS

SEQ ID NO: 813 - DNA, 48 bp, Artificial Sequence; identical to SEQ ID NO: 13
  Synthetic Construct

SEQ ID NO: 814 - protein, 16 aa, Artificial Sequence
  Synthetic Construct
YVHKSGDTNYSPSLKS

SEQ ID NO: 815 - DNA, 72 bp, Artificial Sequence; identical to SEQ ID NO: 15
  Synthetic Construct

SEQ ID NO: 816 - protein, 24 aa, Artificial Sequence
  Synthetic Construct
TLHGRRIYGIVAFNEWFTYFYMDV

SEQ ID NO: 817 - DNA, 693 bp, Artificial Sequence; identical to SEQ ID NO: 113
  Synthetic Construct

SEQ ID NO: 818 - protein, 230 aa, Artificial Sequence; identical to SEQ ID NO: 114
  Synthetic Construct

SEQ ID NO: 819 - DNA, 33 bp, Artificial Sequence; identical to SEQ ID NO: 3
  Synthetic Construct

SEQ ID NO: 820 - protein, 11 aa, Artificial Sequence
  Synthetic Construct
GEKSLGSRAVQ

SEQ ID NO: 821 - DNA, 21 bp, Artificial Sequence
  Synthetic Construct
aataatcaggaccggccctca

SEQ ID NO: 822 - protein, 7 aa, Artificial Sequence
  Synthetic Construct
NNQDRPS

SEQ ID NO: 823 - DNA, 36 bp, Artificial Sequence; identical to SEQ ID NO: 7
  Synthetic Construct

SEQ ID NO: 824 - protein, 12 aa, Artificial Sequence
  Synthetic Construct
HIWDSRVPTKWV

SEQ ID NO: 825 - DNA, 1446 bp, Artificial Sequence; identical to SEQ ID NO: 553
  Synthetic Construct

SEQ ID NO: 826 - protein, 481 aa, Artificial Sequence; identical to SEQ ID NO: 554
  Synthetic Construct

SEQ ID NO: 827 - DNA, 18 bp, Artificial Sequence
  Synthetic Construct
agtgacagttactggagc

SEQ ID NO: 828 - protein, 6 aa, Artificial Sequence
  Synthetic Construct
SDSYWS

SEQ ID NO: 829 - DNA, 48 bp, Artificial Sequence; identical to SEQ ID NO: 13
  Synthetic Construct

SEQ ID NO: 830 - protein, 16 aa, Artificial Sequence
  Synthetic Construct
YVHKSGDTNYSPSLKS

SEQ ID NO: 831 - DNA, 72 bp, Artificial Sequence; identical to SEQ ID NO: 15
  Synthetic Construct

SEQ ID NO: 832 - protein, 24 aa, Artificial Sequence
  Synthetic Construct
TLHGRRIYGIVAFNEWFTYFYMDV

SEQ ID NO: 833 - DNA, 693 bp, Artificial Sequence; identical to SEQ ID NO: 161
  Synthetic Construct

SEQ ID NO: 834 - protein, 230 aa, Artificial Sequence; identical to SEQ ID NO: 162
  Synthetic Construct

SEQ ID NO: 835 - DNA, 33 bp, Artificial Sequence; identical to SEQ ID NO: 3
  Synthetic Construct

SEQ ID NO: 836 - protein, 11 aa, Artificial Sequence
  Synthetic Construct
GEKSLGSRAVQ

SEQ ID NO: 837 - DNA, 21 bp, Artificial Sequence
  Synthetic Construct
aataatcaggaccggccctca

SEQ ID NO: 838 - protein, 7 aa, Artificial Sequence
  Synthetic Construct
NNQDRPS

SEQ ID NO: 839 - DNA, 36 bp, Artificial Sequence; identical to SEQ ID NO: 7
  Synthetic Construct

SEQ ID NO: 840 - protein, 12 aa, Artificial Sequence
  Synthetic Construct
HIWDSRVPTKWV

SEQ ID NO: 841 - DNA, 1446 bp, Artificial Sequence; identical to SEQ ID NO: 697
  Synthetic Construct

SEQ ID NO: 842 - protein, 481 aa, Artificial Sequence; identical to SEQ ID NO: 698
  Synthetic Construct

SEQ ID NO: 843 - DNA, 18 bp, Artificial Sequence
  Synthetic Construct
agtgacagttactggagc

SEQ ID NO: 844 - protein, 6 aa, Artificial Sequence
  Synthetic Construct
SDSYWS

SEQ ID NO: 845 - DNA, 48 bp, Artificial Sequence; identical to SEQ ID NO: 13
  Synthetic Construct

SEQ ID NO: 846 - protein, 16 aa, Artificial Sequence
  Synthetic Construct
YVHKSGDTNYSPSLKS

SEQ ID NO: 847 - DNA, 72 bp, Artificial Sequence; identical to SEQ ID NO: 15
  Synthetic Construct

SEQ ID NO: 848 - protein, 24 aa, Artificial Sequence
  Synthetic Construct
TLHGRRIYGIVAFNEWFTYFYMDV

SEQ ID NO: 849 - DNA, 693 bp, Artificial Sequence; identical to SEQ ID NO: 161
  Synthetic Construct

SEQ ID NO: 850 - protein, 230 aa, Artificial Sequence; identical to SEQ ID NO: 162
  Synthetic Construct

SEQ ID NO: 851 - DNA, 33 bp, Artificial Sequence; identical to SEQ ID NO: 3
  Synthetic Construct

SEQ ID NO: 852 - protein, 11 aa, Artificial Sequence
  Synthetic Construct
GEKSLGSRAVQ

SEQ ID NO: 853 - DNA, 21 bp, Artificial Sequence
  Synthetic Construct
aataatcaggaccggccctca

SEQ ID NO: 854 - protein, 7 aa, Artificial Sequence
  Synthetic Construct
NNQDRPS

SEQ ID NO: 855 - DNA, 36 bp, Artificial Sequence; identical to SEQ ID NO: 7
  Synthetic Construct

SEQ ID NO: 856 - protein, 12 aa, Artificial Sequence
  Synthetic Construct
HIWDSRVPTKWV

SEQ ID NO: 857 - DNA, 1446 bp, Artificial Sequence; identical to SEQ ID NO: 713
  Synthetic Construct

SEQ ID NO: 858 - protein, 481 aa, Artificial Sequence; identical to SEQ ID NO: 714
  Synthetic Construct

SEQ ID NO: 859 - DNA, 18 bp, Artificial Sequence
  Synthetic Construct
agtgacagttactggagc

SEQ ID NO: 860 - protein, 6 aa, Artificial Sequence
  Synthetic Construct
SDSYWS

SEQ ID NO: 861 - DNA, 48 bp, Artificial Sequence; identical to SEQ ID NO: 13
  Synthetic Construct

SEQ ID NO: 862 - protein, 16 aa, Artificial Sequence
  Synthetic Construct
YVHKSGDTNYSPSLKS

SEQ ID NO: 863 - DNA, 72 bp, Artificial Sequence; identical to SEQ ID NO: 15
  Synthetic Construct

SEQ ID NO: 864 - protein, 24 aa, Artificial Sequence
  Synthetic Construct
TLHGRRIYGIVAFNEWFTYFYMDV

SEQ ID NO: 865 - DNA, 693 bp, Artificial Sequence; identical to SEQ ID NO: 161
  Synthetic Construct

SEQ ID NO: 866 - protein, 230 aa, Artificial Sequence; identical to SEQ ID NO: 162
  Synthetic Construct

SEQ ID NO: 867 - DNA, 33 bp, Artificial Sequence; identical to SEQ ID NO: 3
  Synthetic Construct

SEQ ID NO: 868 - protein, 11 aa, Artificial Sequence
  Synthetic Construct
GEKSLGSRAVQ

SEQ ID NO: 869 - DNA, 21 bp, Artificial Sequence
  Synthetic Construct
aataatcaggaccggccctca

SEQ ID NO: 870 - protein, 7 aa, Artificial Sequence
  Synthetic Construct
NNQDRPS

SEQ ID NO: 871 - DNA, 36 bp, Artificial Sequence; identical to SEQ ID NO: 7
  Synthetic Construct

SEQ ID NO: 872 - protein, 12 aa, Artificial Sequence
  Synthetic Construct
HIWDSRVPTKWV

SEQ ID NO: 873 - DNA, 1446 bp, Artificial Sequence; identical to SEQ ID NO: 553
  Synthetic Construct

SEQ ID NO: 874 - protein, 481 aa, Artificial Sequence; identical to SEQ ID NO: 554
  Synthetic Construct

SEQ ID NO: 875 - DNA, 18 bp, Artificial Sequence
  Synthetic Construct
agtgacagttactggagc

SEQ ID NO: 876 - protein, 6 aa, Artificial Sequence
  Synthetic Construct
SDSYWS

SEQ ID NO: 877 - DNA, 48 bp, Artificial Sequence; identical to SEQ ID NO: 13
  Synthetic Construct

SEQ ID NO: 878 - protein, 16 aa, Artificial Sequence
  Synthetic Construct
YVHKSGDTNYSPSLKS

SEQ ID NO: 879 - DNA, 72 bp, Artificial Sequence; identical to SEQ ID NO: 15
  Synthetic Construct

SEQ ID NO: 880 - protein, 24 aa, Artificial Sequence
  Synthetic Construct
TLHGRRIYGIVAFNEWFTYFYMDV

SEQ ID NO: 881 - DNA, 693 bp, Artificial Sequence; identical to SEQ ID NO: 1
  Synthetic Construct

SEQ ID NO: 882 - protein, 230 aa, Artificial Sequence; identical to SEQ ID NO: 2
  Synthetic Construct

SEQ ID NO: 883 - DNA, 33 bp, Artificial Sequence; identical to SEQ ID NO: 3
  Synthetic Construct

SEQ ID NO: 884 - protein, 11 aa, Artificial Sequence
  Synthetic Construct
GEKSLGSRAVQ

SEQ ID NO: 885 - DNA, 21 bp, Artificial Sequence
  Synthetic Construct
aataatcaggaccggccctca

SEQ ID NO: 886 - protein, 7 aa, Artificial Sequence
  Synthetic Construct
NNQDRPS

SEQ ID NO: 887 - DNA, 36 bp, Artificial Sequence; identical to SEQ ID NO: 7
  Synthetic Construct

SEQ ID NO: 888 - protein, 12 aa, Artificial Sequence
  Synthetic Construct
HIWDSRVPTKWV

SEQ ID NO: 889 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgggtccataagtgacagttactggagctggatccggcggccgccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 890 - protein, 481 aa, Artificial Sequence
  Synthetic Construct
MMSFVSLLLVGILFHATQAQMQLQESGPGLVKPSETLSLTCSVSGGSISDSYWSWIRRPPGKGLEWIGYVHKSGDTNYSPSLKSRVNLSLDTSKNQVSLSLSAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 891 - DNA, 18 bp, Artificial Sequence
  Synthetic Construct
agtgacagttactggagc

SEQ ID NO: 892 - protein, 6 aa, Artificial Sequence
  Synthetic Construct
SDSYWS

SEQ ID NO: 893 - DNA, 48 bp, Artificial Sequence; identical to SEQ ID NO: 13
  Synthetic Construct

SEQ ID NO: 894 - protein, 16 aa, Artificial Sequence
  Synthetic Construct
YVHKSGDTNYSPSLKS

SEQ ID NO: 895 - DNA, 72 bp, Artificial Sequence; identical to SEQ ID NO: 15
  Synthetic Construct

SEQ ID NO: 896 - protein, 24 aa, Artificial Sequence
  Synthetic Construct
TLHGRRIYGIVAFNEWFTYFYMDV

SEQ ID NO: 897 - DNA, 693 bp, Artificial Sequence; identical to SEQ ID NO: 577
  Synthetic Construct

SEQ ID NO: 898 - protein, 230 aa, Artificial Sequence; identical to SEQ ID NO: 578
  Synthetic Construct

SEQ ID NO: 899 - DNA, 33 bp, Artificial Sequence; identical to SEQ ID NO: 3
  Synthetic Construct

SEQ ID NO: 900 - protein, 11 aa, Artificial Sequence
  Synthetic Construct
GEKSLGSRAVQ

SEQ ID NO: 901 - DNA, 21 bp, Artificial Sequence
  Synthetic Construct
aataatcaggaccggccctca

SEQ ID NO: 902 - protein, 7 aa, Artificial Sequence
  Synthetic Construct
NNQDRPS

SEQ ID NO: 903 - DNA, 36 bp, Artificial Sequence; identical to SEQ ID NO: 7
  Synthetic Construct

SEQ ID NO: 904 - protein, 12 aa, Artificial Sequence
  Synthetic Construct
HIWDSRVPTKWV

SEQ ID NO: 905 - DNA, 1446 bp, Artificial Sequence; identical to SEQ ID NO: 697
  Synthetic Construct

SEQ ID NO: 906 - protein, 481 aa, Artificial Sequence; identical to SEQ ID NO: 698
  Synthetic Construct

SEQ ID NO: 907 - DNA, 18 bp, Artificial Sequence
  Synthetic Construct
agtgacagttactggagc

SEQ ID NO: 908 - protein, 6 aa, Artificial Sequence
  Synthetic Construct
SDSYWS

SEQ ID NO: 909 - DNA, 48 bp, Artificial Sequence; identical to SEQ ID NO: 13
  Synthetic Construct

SEQ ID NO: 910 - protein, 16 aa, Artificial Sequence
  Synthetic Construct
YVHKSGDTNYSPSLKS

SEQ ID NO: 911 - DNA, 72 bp, Artificial Sequence; identical to SEQ ID NO: 15
  Synthetic Construct

SEQ ID NO: 912 - protein, 24 aa, Artificial Sequence
  Synthetic Construct
TLHGRRIYGIVAFNEWFTYFYMDV

SEQ ID NO: 913 - DNA, 693 bp, Artificial Sequence; identical to SEQ ID NO: 577
  Synthetic Construct

SEQ ID NO: 914 - protein, 230 aa, Artificial Sequence; identical to SEQ ID NO: 578
  Synthetic Construct

SEQ ID NO: 915 - DNA, 33 bp, Artificial Sequence; identical to SEQ ID NO: 3
  Synthetic Construct

SEQ ID NO: 916 - protein, 11 aa, Artificial Sequence
  Synthetic Construct
GEKSLGSRAVQ

SEQ ID NO: 917 - DNA, 21 bp, Artificial Sequence
  Synthetic Construct
aataatcaggaccggccctca

SEQ ID NO: 918 - protein, 7 aa, Artificial Sequence
  Synthetic Construct
NNQDRPS

SEQ ID NO: 919 - DNA, 36 bp, Artificial Sequence; identical to SEQ ID NO: 7
  Synthetic Construct

SEQ ID NO: 920 - protein, 12 aa, Artificial Sequence
  Synthetic Construct
HIWDSRVPTKWV

SEQ ID NO: 921 - DNA, 1446 bp, Artificial Sequence; identical to SEQ ID NO: 713
  Synthetic Construct

SEQ ID NO: 922 - protein, 481 aa, Artificial Sequence; identical to SEQ ID NO: 714
  Synthetic Construct

SEQ ID NO: 923 - DNA, 18 bp, Artificial Sequence
  Synthetic Construct
agtgacagttactggagc

SEQ ID NO: 924 - protein, 6 aa, Artificial Sequence
  Synthetic Construct
SDSYWS

SEQ ID NO: 925 - DNA, 48 bp, Artificial Sequence; identical to SEQ ID NO: 13
  Synthetic Construct

SEQ ID NO: 926 - protein, 16 aa, Artificial Sequence
  Synthetic Construct
YVHKSGDTNYSPSLKS

SEQ ID NO: 927 - DNA, 72 bp, Artificial Sequence; identical to SEQ ID NO: 15
  Synthetic Construct

SEQ ID NO: 928 - protein, 24 aa, Artificial Sequence
  Synthetic Construct
TLHGRRIYGIVAFNEWFTYFYMDV

SEQ ID NO: 929 - DNA, 693 bp, Artificial Sequence; identical to SEQ ID NO: 577
  Synthetic Construct

SEQ ID NO: 930 - protein, 230 aa, Artificial Sequence; identical to SEQ ID NO: 578
  Synthetic Construct

SEQ ID NO: 931 - DNA, 33 bp, Artificial Sequence; identical to SEQ ID NO: 3
  Synthetic Construct

SEQ ID NO: 932 - protein, 11 aa, Artificial Sequence
  Synthetic Construct
GEKSLGSRAVQ

SEQ ID NO: 933 - DNA, 21 bp, Artificial Sequence
  Synthetic Construct
aataatcaggaccggccctca

SEQ ID NO: 934 - protein, 7 aa, Artificial Sequence
  Synthetic Construct
NNQDRPS

SEQ ID NO: 935 - DNA, 36 bp, Artificial Sequence; identical to SEQ ID NO: 7
  Synthetic Construct

SEQ ID NO: 936 - protein, 12 aa, Artificial Sequence
  Synthetic Construct
HIWDSRVPTKWV

SEQ ID NO: 937 - DNA, 1446 bp, Artificial Sequence; identical to SEQ ID NO: 553
  Synthetic Construct

SEQ ID NO: 938 - protein, 481 aa, Artificial Sequence; identical to SEQ ID NO: 554
  Synthetic Construct

SEQ ID NO: 939 - DNA, 18 bp, Artificial Sequence
  Synthetic Construct
agtgacagttactggagc

SEQ ID NO: 940 - protein, 6 aa, Artificial Sequence
  Synthetic Construct
SDSYWS

SEQ ID NO: 941 - DNA, 48 bp, Artificial Sequence; identical to SEQ ID NO: 13
  Synthetic Construct

SEQ ID NO: 942 - protein, 16 aa, Artificial Sequence
  Synthetic Construct
YVHKSGDTNYSPSLKS

SEQ ID NO: 943 - DNA, 72 bp, Artificial Sequence; identical to SEQ ID NO: 15
  Synthetic Construct

SEQ ID NO: 944 - protein, 24 aa, Artificial Sequence
  Synthetic Construct
TLHGRRIYGIVAFNEWFTYFYMDV

SEQ ID NO: 945 - DNA, 693 bp, Artificial Sequence; identical to SEQ ID NO: 113
  Synthetic Construct

SEQ ID NO: 946 - protein, 230 aa, Artificial Sequence; identical to SEQ ID NO: 114
  Synthetic Construct

SEQ ID NO: 947 - DNA, 33 bp, Artificial Sequence; identical to SEQ ID NO: 3
  Synthetic Construct

SEQ ID NO: 948 - protein, 11 aa, Artificial Sequence
  Synthetic Construct
GEKSLGSRAVQ

SEQ ID NO: 949 - DNA, 21 bp, Artificial Sequence
  Synthetic Construct
aataatcaggaccggccctca

SEQ ID NO: 950 - protein, 7 aa, Artificial Sequence
  Synthetic Construct
NNQDRPS

SEQ ID NO: 951 - DNA, 36 bp, Artificial Sequence; identical to SEQ ID NO: 7
  Synthetic Construct

SEQ ID NO: 952 - protein, 12 aa, Artificial Sequence
  Synthetic Construct
HIWDSRVPTKWV

SEQ ID NO: 953 - DNA, 1446 bp, Artificial Sequence; identical to SEQ ID NO: 889
  Synthetic Construct

SEQ ID NO: 954 - protein, 481 aa, Artificial Sequence; identical to SEQ ID NO: 890
  Synthetic Construct

SEQ ID NO: 955 - DNA, 18 bp, Artificial Sequence
  Synthetic Construct
agtgacagttactggagc

SEQ ID NO: 956 - protein, 6 aa, Artificial Sequence
  Synthetic Construct
SDSYWS

SEQ ID NO: 957 - DNA, 48 bp, Artificial Sequence; identical to SEQ ID NO: 13
  Synthetic Construct

SEQ ID NO: 958 - protein, 16 aa, Artificial Sequence
  Synthetic Construct
YVHKSGDTNYSPSLKS

SEQ ID NO: 959 - DNA, 72 bp, Artificial Sequence; identical to SEQ ID NO: 15
  Synthetic Construct

SEQ ID NO: 960 - protein, 24 aa, Artificial Sequence
  Synthetic Construct
TLHGRRIYGIVAFNEWFTYFYMDV

SEQ ID NO: 961 - DNA, 693 bp, Artificial Sequence; identical to SEQ ID NO: 161
  Synthetic Construct

SEQ ID NO: 962 - protein, 230 aa, Artificial Sequence; identical to SEQ ID NO: 162
  Synthetic Construct

SEQ ID NO: 963 - DNA, 33 bp, Artificial Sequence; identical to SEQ ID NO: 3
  Synthetic Construct

SEQ ID NO: 964 - protein, 11 aa, Artificial Sequence
  Synthetic Construct
GEKSLGSRAVQ

SEQ ID NO: 965 - DNA, 21 bp, Artificial Sequence
  Synthetic Construct
aataatcaggaccggccctca

SEQ ID NO: 966 - protein, 7 aa, Artificial Sequence
  Synthetic Construct
NNQDRPS

SEQ ID NO: 967 - DNA, 36 bp, Artificial Sequence; identical to SEQ ID NO: 7
  Synthetic Construct

SEQ ID NO: 968 - protein, 12 aa, Artificial Sequence
  Synthetic Construct
HIWDSRVPTKWV

SEQ ID NO: 969 - DNA, 1446 bp, Artificial Sequence; identical to SEQ ID NO: 889
  Synthetic Construct

SEQ ID NO: 970 - protein, 481 aa, Artificial Sequence; identical to SEQ ID NO: 890
  Synthetic Construct

SEQ ID NO: 971 - DNA, 18 bp, Artificial Sequence
  Synthetic Construct
agtgacagttactggagc

SEQ ID NO: 972 - protein, 6 aa, Artificial Sequence
  Synthetic Construct
SDSYWS

SEQ ID NO: 973 - DNA, 48 bp, Artificial Sequence; identical to SEQ ID NO: 13
  Synthetic Construct

SEQ ID NO: 974 - protein, 16 aa, Artificial Sequence
  Synthetic Construct
YVHKSGDTNYSPSLKS

SEQ ID NO: 975 - DNA, 72 bp, Artificial Sequence; identical to SEQ ID NO: 15
  Synthetic Construct

SEQ ID NO: 976 - protein, 24 aa, Artificial Sequence
  Synthetic Construct
TLHGRRIYGIVAFNEWFTYFYMDV

SEQ ID NO: 977 - DNA, 693 bp, Artificial Sequence; identical to SEQ ID NO: 577
  Synthetic Construct

SEQ ID NO: 978 - protein, 230 aa, Artificial Sequence; identical to SEQ ID NO: 578
  Synthetic Construct

SEQ ID NO: 979 - DNA, 33 bp, Artificial Sequence; identical to SEQ ID NO: 3
  Synthetic Construct

SEQ ID NO: 980 - protein, 11 aa, Artificial Sequence
  Synthetic Construct
GEKSLGSRAVQ

SEQ ID NO: 981 - DNA, 21 bp, Artificial Sequence
  Synthetic Construct
aataatcaggaccggccctca

SEQ ID NO: 982 - protein, 7 aa, Artificial Sequence
  Synthetic Construct
NNQDRPS

SEQ ID NO: 983 - DNA, 36 bp, Artificial Sequence; identical to SEQ ID NO: 7
  Synthetic Construct

SEQ ID NO: 984 - protein, 12 aa, Artificial Sequence
  Synthetic Construct
HIWDSRVPTKWV

SEQ ID NO: 985 - DNA, 1446 bp, Artificial Sequence; identical to SEQ ID NO: 889
  Synthetic Construct

SEQ ID NO: 986 - protein, 481 aa, Artificial Sequence; identical to SEQ ID NO: 890
  Synthetic Construct

SEQ ID NO: 987 - DNA, 18 bp, Artificial Sequence
  Synthetic Construct
agtgacagttactggagc

SEQ ID NO: 988 - protein, 6 aa, Artificial Sequence
  Synthetic Construct
SDSYWS

SEQ ID NO: 989 - DNA, 48 bp, Artificial Sequence; identical to SEQ ID NO: 13
  Synthetic Construct

SEQ ID NO: 990 - protein, 16 aa, Artificial Sequence
  Synthetic Construct
YVHKSGDTNYSPSLKS

SEQ ID NO: 991 - DNA, 72 bp, Artificial Sequence; identical to SEQ ID NO: 15
  Synthetic Construct

SEQ ID NO: 992 - protein, 24 aa, Artificial Sequence
  Synthetic Construct
TLHGRRIYGIVAFNEWFTYFYMDV

SEQ ID NO: 993 - DNA, 693 bp, Artificial Sequence; identical to SEQ ID NO: 529
  Synthetic Construct

SEQ ID NO: 994 - protein, 230 aa, Artificial Sequence; identical to SEQ ID NO: 530
  Synthetic Construct

SEQ ID NO: 995 - DNA, 33 bp, Artificial Sequence; identical to SEQ ID NO: 3
  Synthetic Construct

SEQ ID NO: 996 - protein, 11 aa, Artificial Sequence
  Synthetic Construct
GEKSLGSRAVQ

SEQ ID NO: 997 - DNA, 21 bp, Artificial Sequence
  Synthetic Construct
aataatcaggaccggccctca

SEQ ID NO: 998 - protein, 7 aa, Artificial Sequence
  Synthetic Construct
NNQDRPS

SEQ ID NO: 999 - DNA, 36 bp, Artificial Sequence; identical to SEQ ID NO: 7
  Synthetic Construct

SEQ ID NO: 1000 - protein, 12 aa, Artificial Sequence
  Synthetic Construct
HIWDSRVPTKWV

SEQ ID NO: 1001 - DNA, 1446 bp, Artificial Sequence; identical to SEQ ID NO: 233
  Synthetic Construct

SEQ ID NO: 1002 - protein, 481 aa, Artificial Sequence; identical to SEQ ID NO: 234
  Synthetic Construct

SEQ ID NO: 1003 - DNA, 18 bp, Artificial Sequence
  Synthetic Construct
agtgacagttactggagc

SEQ ID NO: 1004 - protein, 6 aa, Artificial Sequence
  Synthetic Construct
SDSYWS

SEQ ID NO: 1005 - DNA, 48 bp, Artificial Sequence; identical to SEQ ID NO: 13
  Synthetic Construct

SEQ ID NO: 1006 - protein, 16 aa, Artificial Sequence
  Synthetic Construct
YVHKSGDTNYSPSLKS

SEQ ID NO: 1007 - DNA, 72 bp, Artificial Sequence; identical to SEQ ID NO: 15
  Synthetic Construct

SEQ ID NO: 1008 - protein, 24 aa, Artificial Sequence
  Synthetic Construct
TLHGRRIYGIVAFNEWFTYFYMDV

SEQ ID NO: 1009 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacagagggccggccaggccccctctttaatcatatataataatcaggaccggccctcagggatccctgagcgattctctggctcccctgactccggatttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1010 - protein, 230 aa, Artificial Sequence
  Synthetic Construct
MMSFVSLLLVGILFHATQASDISVAPGETARISCGEKSLGSRAVQWYQQRAGQAPSLIIYNNQDRPSGIPERFSGSPDSGFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1011 - DNA, 33 bp, Artificial Sequence; identical to SEQ ID NO: 3
  Synthetic Construct

SEQ ID NO: 1012 - protein, 11 aa, Artificial Sequence
  Synthetic Construct
GEKSLGSRAVQ

SEQ ID NO: 1013 - DNA, 21 bp, Artificial Sequence
  Synthetic Construct
aataatcaggaccggccctca

SEQ ID NO: 1014 - protein, 7 aa, Artificial Sequence
  Synthetic Construct
NNQDRPS

SEQ ID NO: 1015 - DNA, 36 bp, Artificial Sequence; identical to SEQ ID NO: 7
  Synthetic Construct

SEQ ID NO: 1016 - protein, 12 aa, Artificial Sequence
  Synthetic Construct
HIWDSRVPTKWV

SEQ ID NO: 1017 - DNA, 1446 bp, Artificial Sequence; identical to SEQ ID NO: 233
  Synthetic Construct

SEQ ID NO: 1018 - protein, 481 aa, Artificial Sequence; identical to SEQ ID NO: 234
  Synthetic Construct

SEQ ID NO: 1019 - DNA, 18 bp, Artificial Sequence
  Synthetic Construct
agtgacagttactggagc

SEQ ID NO: 1020 - protein, 6 aa, Artificial Sequence
  Synthetic Construct
SDSYWS

SEQ ID NO: 1021 - DNA, 48 bp, Artificial Sequence; identical to SEQ ID NO: 13
  Synthetic Construct

SEQ ID NO: 1022 - protein, 16 aa, Artificial Sequence
  Synthetic Construct
YVHKSGDTNYSPSLKS

SEQ ID NO: 1023 - DNA, 72 bp, Artificial Sequence; identical to SEQ ID NO: 15
  Synthetic Construct

SEQ ID NO: 1024 - protein, 24 aa, Artificial Sequence
  Synthetic Construct
TLHGRRIYGIVAFNEWFTYFYMDV

SEQ ID NO: 1025 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacagagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1026 - protein, 230 aa, Artificial Sequence
  Synthetic Construct
MMSFVSLLLVGILFHATQASDISVAPGETARISCGEKSLGSRAVQWYQQRAGQAPSLIIYNNQDRPSGIPERFSGSPDSPFGTTATLTITSVEAGDEADYYCHIWDSRVPTKWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1027 - DNA, 33 bp, Artificial Sequence; identical to SEQ ID NO: 3
  Synthetic Construct

SEQ ID NO: 1028 - protein, 11 aa, Artificial Sequence
  Synthetic Construct
GEKSLGSRAVQ

SEQ ID NO: 1029 - DNA, 21 bp, Artificial Sequence
  Synthetic Construct
aataatcaggaccggccctca

SEQ ID NO: 1030 - protein, 7 aa, Artificial Sequence
  Synthetic Construct
NNQDRPS

SEQ ID NO: 1031 - DNA, 36 bp, Artificial Sequence; identical to SEQ ID NO: 7
  Synthetic Construct

SEQ ID NO: 1032 - protein, 12 aa, Artificial Sequence
  Synthetic Construct
HIWDSRVPTKWV

SEQ ID NO: 1033 - DNA, 1446 bp, Artificial Sequence; identical to SEQ ID NO: 233
  Synthetic Construct

SEQ ID NO: 1034 - protein, 481 aa, Artificial Sequence; identical to SEQ ID NO: 234
  Synthetic Construct

SEQ ID NO: 1035 - DNA, 18 bp, Artificial Sequence
  Synthetic Construct
agtgacagttactggagc

SEQ ID NO: 1036 - protein, 6 aa, Artificial Sequence
  Synthetic Construct
SDSYWS

SEQ ID NO: 1037 - DNA, 48 bp, Artificial Sequence; identical to SEQ ID NO: 13
  Synthetic Construct

SEQ ID NO: 1038 - protein, 16 aa, Artificial Sequence
  Synthetic Construct
YVHKSGDTNYSPSLKS

SEQ ID NO: 1039 - DNA, 72 bp, Artificial Sequence; identical to SEQ ID NO: 15
  Synthetic Construct

SEQ ID NO: 1040 - protein, 24 aa, Artificial Sequence
  Synthetic Construct
TLHGRRIYGIVAFNEWFTYFYMDV

SEQ ID NO: 1041 - DNA, 693 bp, Artificial Sequence; identical to SEQ ID NO: 65
  Synthetic Construct

SEQ ID NO: 1042 - protein, 230 aa, Artificial Sequence; identical to SEQ ID NO: 66
  Synthetic Construct

SEQ ID NO: 1043 - DNA, 33 bp, Artificial Sequence; identical to SEQ ID NO: 3
  Synthetic Construct

SEQ ID NO: 1044 - protein, 11 aa, Artificial Sequence
  Synthetic Construct
GEKSLGSRAVQ

SEQ ID NO: 1045 - DNA, 21 bp, Artificial Sequence
  Synthetic Construct
aataatcaggaccggccctca

SEQ ID NO: 1046 - protein, 7 aa, Artificial Sequence
  Synthetic Construct
NNQDRPS

SEQ ID NO: 1047 - DNA, 36 bp, Artificial Sequence; identical to SEQ ID NO: 7
  Synthetic Construct

SEQ ID NO: 1048 - protein, 12 aa, Artificial Sequence
  Synthetic Construct
HIWDSRVPTKWV

SEQ ID NO: 1049 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaaccgccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 1050 - protein, 481 aa, Artificial Sequence
  Synthetic Construct
MMSFVSLLLVGILFHATQAQMQLQESGPGLVKPSETLSLTCSVSGASISDSYWSWIRQPPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1051 - DNA, 18 bp, Artificial Sequence
  Synthetic Construct
agtgacagttactggagc

SEQ ID NO: 1052 - protein, 6 aa, Artificial Sequence
  Synthetic Construct
SDSYWS

SEQ ID NO: 1053 - DNA, 48 bp, Artificial Sequence; identical to SEQ ID NO: 13
  Synthetic Construct

SEQ ID NO: 1054 - protein, 16 aa, Artificial Sequence
  Synthetic Construct
YVHKSGDTNYSPSLKS

SEQ ID NO: 1055 - DNA, 72 bp, Artificial Sequence; identical to SEQ ID NO: 15
  Synthetic Construct

SEQ ID NO: 1056 - protein, 24 aa, Artificial Sequence
  Synthetic Construct
TLHGRRIYGIVAFNEWFTYFYMDV

SEQ ID NO: 1057 - DNA, 693 bp, Artificial Sequence; identical to SEQ ID NO: 65
  Synthetic Construct

SEQ ID NO: 1058 - protein, 230 aa, Artificial Sequence; identical to SEQ ID NO: 66
  Synthetic Construct

SEQ ID NO: 1059 - DNA, 33 bp, Artificial Sequence; identical to SEQ ID NO: 3
  Synthetic Construct

SEQ ID NO: 1060 - protein, 11 aa, Artificial Sequence
  Synthetic Construct
GEKSLGSRAVQ

SEQ ID NO: 1061 - DNA, 21 bp, Artificial Sequence
  Synthetic Construct
aataatcaggaccggccctca

SEQ ID NO: 1062 - protein, 7 aa, Artificial Sequence
  Synthetic Construct
NNQDRPS

SEQ ID NO: 1063 - DNA, 36 bp, Artificial Sequence; identical to SEQ ID NO: 7
  Synthetic Construct

SEQ ID NO: 1064 - protein, 12 aa, Artificial Sequence
  Synthetic Construct
HIWDSRVPTKWV

SEQ ID NO: 1065 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaatccccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 1066 - protein, 481 aa, Artificial Sequence
  Synthetic Construct
MMSFVSLLLVGILFHATQAQMQLQESGPGLVKPSETLSLTCSVSGASISDSYWSWIRQSPGKGLEWIGYVHKSGDTNYSPSLKSRVNLSLDTSKNQVSLSLSAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1067 - DNA, 18 bp, Artificial Sequence
  Synthetic Construct
agtgacagttactggagc

SEQ ID NO: 1068 - protein, 6 aa, Artificial Sequence
  Synthetic Construct
SDSYWS

SEQ ID NO: 1069 - DNA, 48 bp, Artificial Sequence; identical to SEQ ID NO: 13
  Synthetic Construct

SEQ ID NO: 1070 - protein, 16 aa, Artificial Sequence
  Synthetic Construct
YVHKSGDTNYSPSLKS

SEQ ID NO: 1071 - DNA, 72 bp, Artificial Sequence; identical to SEQ ID NO: 15
  Synthetic Construct

SEQ ID NO: 1072 - protein, 24 aa, Artificial Sequence
  Synthetic Construct
TLHGRRIYGIVAFNEWFTYFYMDV

SEQ ID NO: 1073 - DNA, 693 bp, Artificial Sequence; identical to SEQ ID NO: 65
  Synthetic Construct

SEQ ID NO: 1074 - protein, 230 aa, Artificial Sequence; identical to SEQ ID NO: 66
  Synthetic Construct

SEQ ID NO: 1075 - DNA, 33 bp, Artificial Sequence; identical to SEQ ID NO: 3
  Synthetic Construct

SEQ ID NO: 1076 - protein, 11 aa, Artificial Sequence
  Synthetic Construct
GEKSLGSRAVQ

SEQ ID NO: 1077 - DNA, 21 bp, Artificial Sequence
  Synthetic Construct
aataatcaggaccggccctca

SEQ ID NO: 1078 - protein, 7 aa, Artificial Sequence
  Synthetic Construct
NNQDRPS

SEQ ID NO: 1079 - DNA, 36 bp, Artificial Sequence; identical to SEQ ID NO: 7
  Synthetic Construct

SEQ ID NO: 1080 - protein, 12 aa, Artificial Sequence
  Synthetic Construct
HIWDSRVPTKWV

SEQ ID NO: 1081 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaatccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcgtctattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 1082 - protein, 481 aa, Artificial Sequence
  Synthetic Construct
MMSFVSLLLVGILFHATQAQMQLQESGPGLVKPSETLSLTCSVSGASISDSYWSWIRQSPGKGLEWIGYVHKSGDTNYSPSLKSRVNLSLDTSKNQVSLSLVAATAADSGVYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1083 - DNA, 18 bp, Artificial Sequence
  Synthetic Construct
agtgacagttactggagc

SEQ ID NO: 1084 - protein, 6 aa, Artificial Sequence
  Synthetic Construct
SDSYWS

SEQ ID NO: 1085 - DNA, 48 bp, Artificial Sequence; identical to SEQ ID NO: 13
  Synthetic Construct

SEQ ID NO: 1086 - protein, 16 aa, Artificial Sequence
  Synthetic Construct
YVHKSGDTNYSPSLKS

SEQ ID NO: 1087 - DNA, 72 bp, Artificial Sequence; identical to SEQ ID NO: 15
  Synthetic Construct

SEQ ID NO: 1088 - protein, 24 aa, Artificial Sequence
  Synthetic Construct
TLHGRRIYGIVAFNEWFTYFYMDV

SEQ ID NO: 1089 - DNA, 693 bp, Artificial Sequence; identical to SEQ ID NO: 529
  Synthetic Construct

SEQ ID NO: 1090 - protein, 230 aa, Artificial Sequence; identical to SEQ ID NO: 530
  Synthetic Construct

SEQ ID NO: 1091 - DNA, 33 bp, Artificial Sequence; identical to SEQ ID NO: 3
  Synthetic Construct

SEQ ID NO: 1092 - protein, 11 aa, Artificial Sequence
  Synthetic Construct
GEKSLGSRAVQ

SEQ ID NO: 1093 - DNA, 21 bp, Artificial Sequence
  Synthetic Construct
aataatcaggaccggccctca

SEQ ID NO: 1094 - protein, 7 aa, Artificial Sequence
  Synthetic Construct
NNQDRPS

SEQ ID NO: 1095 - DNA, 36 bp, Artificial Sequence; identical to SEQ ID NO: 7
  Synthetic Construct

SEQ ID NO: 1096 - protein, 12 aa, Artificial Sequence
  Synthetic Construct
HIWDSRVPTKWV

SEQ ID NO: 1097 - DNA, 1446 bp, Artificial Sequence; identical to SEQ ID NO: 1049
  Synthetic Construct

SEQ ID NO: 1098 - protein, 481 aa, Artificial Sequence; identical to SEQ ID NO: 1050
  Synthetic Construct

SEQ ID NO: 1099 - DNA, 18 bp, Artificial Sequence
  Synthetic Construct
agtgacagttactggagc

SEQ ID NO: 1100 - protein, 6 aa, Artificial Sequence
  Synthetic Construct
SDSYWS

SEQ ID NO: 1101 - DNA, 48 bp, Artificial Sequence; identical to SEQ ID NO: 13
  Synthetic Construct

SEQ ID NO: 1102 - protein, 16 aa, Artificial Sequence
  Synthetic Construct
YVHKSGDTNYSPSLKS

SEQ ID NO: 1103 - DNA, 72 bp, Artificial Sequence; identical to SEQ ID NO: 15
  Synthetic Construct

SEQ ID NO: 1104 - protein, 24 aa, Artificial Sequence
  Synthetic Construct
TLHGRRIYGIVAFNEWFTYFYMDV

SEQ ID NO: 1105 - DNA, 693 bp, Artificial Sequence; identical to SEQ ID NO: 529
  Synthetic Construct

SEQ ID NO: 1106 - protein, 230 aa, Artificial Sequence; identical to SEQ ID NO: 530
  Synthetic Construct

SEQ ID NO: 1107 - DNA, 33 bp, Artificial Sequence; identical to SEQ ID NO: 3
  Synthetic Construct

SEQ ID NO: 1108 - protein, 11 aa, Artificial Sequence
  Synthetic Construct
GEKSLGSRAVQ

SEQ ID NO: 1109 - DNA, 21 bp, Artificial Sequence
  Synthetic Construct
aataatcaggaccggccctca

SEQ ID NO: 1110 - protein, 7 aa, Artificial Sequence
  Synthetic Construct
NNQDRPS

SEQ ID NO: 1111 - DNA, 36 bp, Artificial Sequence; identical to SEQ ID NO: 7
  Synthetic Construct

SEQ ID NO: 1112 - protein, 12 aa, Artificial Sequence
  Synthetic Construct
HIWDSRVPTKWV

SEQ ID NO: 1113 - DNA, 1446 bp, Artificial Sequence; identical to SEQ ID NO: 1081
  Synthetic Construct

SEQ ID NO: 1114 - protein, 481 aa, Artificial Sequence; identical to SEQ ID NO: 1082
  Synthetic Construct

SEQ ID NO: 1115 - DNA, 18 bp, Artificial Sequence
  Synthetic Construct
agtgacagttactggagc

SEQ ID NO: 1116 - protein, 6 aa, Artificial Sequence
  Synthetic Construct
SDSYWS

SEQ ID NO: 1117 - DNA, 48 bp, Artificial Sequence; identical to SEQ ID NO: 13
  Synthetic Construct

SEQ ID NO: 1118 - protein, 16 aa, Artificial Sequence
  Synthetic Construct
YVHKSGDTNYSPSLKS

SEQ ID NO: 1119 - DNA, 72 bp, Artificial Sequence; identical to SEQ ID NO: 15
  Synthetic Construct

SEQ ID NO: 1120 - protein, 24 aa, Artificial Sequence
  Synthetic Construct
TLHGRRIYGIVAFNEWFTYFYMDV

SEQ ID NO: 1121 - DNA, 693 bp, Artificial Sequence
  Synthetic Construct
atgatgtcctttgtctctctgctcctggttggcatcctattccatgccacccaggcctccgatatatctgtggccccaggagagacggccaggatttcctgtggggaaaagagccttggaagtagagctgtacaatggtatcaacagagggccggccaggccccctctttaatcatatataataatcaggaccggccctcagggatccctgagcgattctctggctcccctgactccggatttgggaccacggccaccctgaccatcaccagtgtcgaagccggggatgaggccgactattactgtcatatatgggatagtagagttcccaccaaatgggtcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1122 - protein, 230 aa, Artificial Sequence
  Synthetic Construct
MMSFVSLLLVGILFHATQASDISVAPGETARISCGEKSLGSRAVQWYQQRAGQAPSLIIYNNQDRPSGIPERFSGSPDSGFGTTATLTITSVEAGDEADYYCHIWDSRVPTKWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1123 - DNA, 33 bp, Artificial Sequence; identical to SEQ ID NO: 3
  Synthetic Construct

SEQ ID NO: 1124 - protein, 11 aa, Artificial Sequence
  Synthetic Construct
GEKSLGSRAVQ

SEQ ID NO: 1125 - DNA, 21 bp, Artificial Sequence
  Synthetic Construct
aataatcaggaccggccctca

SEQ ID NO: 1126 - protein, 7 aa, Artificial Sequence
  Synthetic Construct
NNQDRPS

SEQ ID NO: 1127 - DNA, 36 bp, Artificial Sequence; identical to SEQ ID NO: 7
  Synthetic Construct

SEQ ID NO: 1128 - protein, 12 aa, Artificial Sequence
  Synthetic Construct
HIWDSRVPTKWV

SEQ ID NO: 1129 - DNA, 1446 bp, Artificial Sequence; identical to SEQ ID NO: 233
  Synthetic Construct

SEQ ID NO: 1130 - protein, 481 aa, Artificial Sequence; identical to SEQ ID NO: 234
  Synthetic Construct

SEQ ID NO: 1131 - DNA, 18 bp, Artificial Sequence
  Synthetic Construct
agtgacagttactggagc

SEQ ID NO: 1132 - protein, 6 aa, Artificial Sequence
  Synthetic Construct
SDSYWS

SEQ ID NO: 1133 - DNA, 48 bp, Artificial Sequence; identical to SEQ ID NO: 13
  Synthetic Construct

SEQ ID NO: 1134 - protein, 16 aa, Artificial Sequence
  Synthetic Construct
YVHKSGDTNYSPSLKS

SEQ ID NO: 1135 - DNA, 72 bp, Artificial Sequence; identical to SEQ ID NO: 15
  Synthetic Construct

SEQ ID NO: 1136 - protein, 24 aa, Artificial Sequence
  Synthetic Construct
TLHGRRIYGIVAFNEWFTYFYMDV

SEQ ID NO: 1137 - DNA, 693 bp, Artificial Sequence; identical to SEQ ID NO: 1009
  Synthetic Construct

SEQ ID NO: 1138 - protein, 230 aa, Artificial Sequence; identical to SEQ ID NO: 1010
  Synthetic Construct

SEQ ID NO: 1139 - DNA, 33 bp, Artificial Sequence; identical to SEQ ID NO: 3
  Synthetic Construct

SEQ ID NO: 1140 - protein, 11 aa, Artificial Sequence
  Synthetic Construct
GEKSLGSRAVQ

SEQ ID NO: 1141 - DNA, 21 bp, Artificial Sequence
  Synthetic Construct
aataatcaggaccggccctca

SEQ ID NO: 1142 - protein, 7 aa, Artificial Sequence
  Synthetic Construct
NNQDRPS

SEQ ID NO: 1143 - DNA, 36 bp, Artificial Sequence; identical to SEQ ID NO: 7
  Synthetic Construct

SEQ ID NO: 1144 - protein, 12 aa, Artificial Sequence
  Synthetic Construct
HIWDSRVPTKWV

SEQ ID NO: 1145 - DNA, 1446 bp, Artificial Sequence; identical to SEQ ID NO: 1065
  Synthetic Construct

SEQ ID NO: 1146 - protein, 481 aa, Artificial Sequence; identical to SEQ ID NO: 1066
  Synthetic Construct

SEQ ID NO: 1147 - DNA, 18 bp, Artificial Sequence
  Synthetic Construct
agtgacagttactggagc

SEQ ID NO: 1148 - protein, 6 aa, Artificial Sequence
  Synthetic Construct
SDSYWS

SEQ ID NO: 1149 - DNA, 48 bp, Artificial Sequence; identical to SEQ ID NO: 13
  Synthetic Construct

SEQ ID NO: 1150 - protein, 16 aa, Artificial Sequence
  Synthetic Construct
YVHKSGDTNYSPSLKS

SEQ ID NO: 1151 - DNA, 72 bp, Artificial Sequence; identical to SEQ ID NO: 15
  Synthetic Construct

SEQ ID NO: 1152 - protein, 24 aa, Artificial Sequence
  Synthetic Construct
TLHGRRIYGIVAFNEWFTYFYMDV

SEQ ID NO: 1153 - DNA, 693 bp, Artificial Sequence; identical to SEQ ID NO: 1025
  Synthetic Construct

SEQ ID NO: 1154 - protein, 230 aa, Artificial Sequence; identical to SEQ ID NO: 1026
  Synthetic Construct

SEQ ID NO: 1155 - DNA, 33 bp, Artificial Sequence; identical to SEQ ID NO: 3
  Synthetic Construct

SEQ ID NO: 1156 - protein, 11 aa, Artificial Sequence
  Synthetic Construct
GEKSLGSRAVQ

SEQ ID NO: 1157 - DNA, 21 bp, Artificial Sequence
  Synthetic Construct
aataatcaggaccggccctca

SEQ ID NO: 1158 - protein, 7 aa, Artificial Sequence
  Synthetic Construct
NNQDRPS

SEQ ID NO: 1159 - DNA, 36 bp, Artificial Sequence; identical to SEQ ID NO: 7
  Synthetic Construct

SEQ ID NO: 1160 - protein, 12 aa, Artificial Sequence
  Synthetic Construct
HIWDSRVPTKWV

SEQ ID NO: 1161 - DNA, 1446 bp, Artificial Sequence; identical to SEQ ID NO: 1065
  Synthetic Construct

SEQ ID NO: 1162 - protein, 481 aa, Artificial Sequence; identical to SEQ ID NO: 1066
  Synthetic Construct

SEQ ID NO: 1163 - DNA, 18 bp, Artificial Sequence
  Synthetic Construct
agtgacagttactggagc

SEQ ID NO: 1164 - protein, 6 aa, Artificial Sequence
  Synthetic Construct
SDSYWS

SEQ ID NO: 1165 - DNA, 48 bp, Artificial Sequence; identical to SEQ ID NO: 13
  Synthetic Construct

SEQ ID NO: 1166 - protein, 16 aa, Artificial Sequence
  Synthetic Construct
YVHKSGDTNYSPSLKS

SEQ ID NO: 1167 - DNA, 72 bp, Artificial Sequence; identical to SEQ ID NO: 15
  Synthetic Construct

SEQ ID NO: 1168 - protein, 24 aa, Artificial Sequence
  Synthetic Construct
TLHGRRIYGIVAFNEWFTYFYMDV

SEQ ID NO: 1169 - DNA, 693 bp, Artificial Sequence; identical to SEQ ID NO: 65
  Synthetic Construct

SEQ ID NO: 1170 - protein, 230 aa, Artificial Sequence; identical to SEQ ID NO: 66
  Synthetic Construct

SEQ ID NO: 1171 - DNA, 33 bp, Artificial Sequence; identical to SEQ ID NO: 3
  Synthetic Construct

SEQ ID NO: 1172 - protein, 11 aa, Artificial Sequence
  Synthetic Construct
GEKSLGSRAVQ

SEQ ID NO: 1173 - DNA, 21 bp, Artificial Sequence
  Synthetic Construct
aataatcaggaccggccctca

SEQ ID NO: 1174 - protein, 7 aa, Artificial Sequence
  Synthetic Construct
NNQDRPS

SEQ ID NO: 1175 - DNA, 36 bp, Artificial Sequence; identical to SEQ ID NO: 7
  Synthetic Construct

SEQ ID NO: 1176 - protein, 12 aa, Artificial Sequence
  Synthetic Construct
HIWDSRVPTKWV

SEQ ID NO: 1177 - DNA, 1446 bp, Artificial Sequence; identical to SEQ ID NO: 489
  Synthetic Construct

SEQ ID NO: 1178 - protein, 481 aa, Artificial Sequence; identical to SEQ ID NO: 490
  Synthetic Construct

SEQ ID NO: 1179 - DNA, 18 bp, Artificial Sequence
  Synthetic Construct
agtgacagttactggagc

SEQ ID NO: 1180 - protein, 6 aa, Artificial Sequence
  Synthetic Construct
SDSYWS

SEQ ID NO: 1181 - DNA, 48 bp, Artificial Sequence; identical to SEQ ID NO: 13
  Synthetic Construct

SEQ ID NO: 1182 - protein, 16 aa, Artificial Sequence
  Synthetic Construct
YVHKSGDTNYSPSLKS

SEQ ID NO: 1183 - DNA, 72 bp, Artificial Sequence; identical to SEQ ID NO: 15
  Synthetic Construct

SEQ ID NO: 1184 - protein, 24 aa, Artificial Sequence
  Synthetic Construct
TLHGRRIYGIVAFNEWFTYFYMDV

SEQ ID NO: 1185 - DNA, 693 bp, Artificial Sequence; identical to SEQ ID NO: 529
  Synthetic Construct

SEQ ID NO: 1186 - protein, 230 aa, Artificial Sequence; identical to SEQ ID NO: 530
  Synthetic Construct

SEQ ID NO: 1187 - DNA, 33 bp, Artificial Sequence; identical to SEQ ID NO: 3
  Synthetic Construct

SEQ ID NO: 1188 - protein, 11 aa, Artificial Sequence
  Synthetic Construct
GEKSLGSRAVQ

SEQ ID NO: 1189 - DNA, 21 bp, Artificial Sequence
  Synthetic Construct
aataatcaggaccggccctca

SEQ ID NO: 1190 - protein, 7 aa, Artificial Sequence
  Synthetic Construct
NNQDRPS

SEQ ID NO: 1191 - DNA, 36 bp, Artificial Sequence; identical to SEQ ID NO: 7
  Synthetic Construct

SEQ ID NO: 1192 - protein, 12 aa, Artificial Sequence
  Synthetic Construct
HIWDSRVPTKWV

SEQ ID NO: 1193 - DNA, 1446 bp, Artificial Sequence; identical to SEQ ID NO: 489
  Synthetic Construct

SEQ ID NO: 1194 - protein, 481 aa, Artificial Sequence; identical to SEQ ID NO: 490
  Synthetic Construct

SEQ ID NO: 1195 - DNA, 18 bp, Artificial Sequence
  Synthetic Construct
agtgacagttactggagc

SEQ ID NO: 1196 - protein, 6 aa, Artificial Sequence
  Synthetic Construct
SDSYWS

SEQ ID NO: 1197 - DNA, 48 bp, Artificial Sequence; identical to SEQ ID NO: 13
  Synthetic Construct

SEQ ID NO: 1198 - protein, 16 aa, Artificial Sequence
  Synthetic Construct
YVHKSGDTNYSPSLKS

SEQ ID NO: 1199 - DNA, 72 bp, Artificial Sequence; identical to SEQ ID NO: 15
  Synthetic Construct

SEQ ID NO: 1200 - protein, 24 aa, Artificial Sequence
  Synthetic Construct
TLHGRRIYGIVAFNEWFTYFYMDV

SEQ ID NO: 1201 - DNA, 693 bp, Artificial Sequence; identical to SEQ ID NO: 1121
  Synthetic Construct

SEQ ID NO: 1202 - protein, 230 aa, Artificial Sequence; identical to SEQ ID NO: 1122
  Synthetic Construct

SEQ ID NO: 1203 - DNA, 33 bp, Artificial Sequence; identical to SEQ ID NO: 3
  Synthetic Construct

SEQ ID NO: 1204 - protein, 11 aa, Artificial Sequence
  Synthetic Construct
GEKSLGSRAVQ

SEQ ID NO: 1205 - DNA, 21 bp, Artificial Sequence
  Synthetic Construct
aataatcaggaccggccctca

SEQ ID NO: 1206 - protein, 7 aa, Artificial Sequence
  Synthetic Construct
NNQDRPS

SEQ ID NO: 1207 - DNA, 36 bp, Artificial Sequence; identical to SEQ ID NO: 7
  Synthetic Construct

SEQ ID NO: 1208 - protein, 12 aa, Artificial Sequence
  Synthetic Construct
HIWDSRVPTKWV

SEQ ID NO: 1209 - DNA, 1446 bp, Artificial Sequence; identical to SEQ ID NO: 1065
  Synthetic Construct

SEQ ID NO: 1210 - protein, 481 aa, Artificial Sequence; identical to SEQ ID NO: 1066
  Synthetic Construct

SEQ ID NO: 1211 - DNA, 18 bp, Artificial Sequence
  Synthetic Construct
agtgacagttactggagc

SEQ ID NO: 1212 - protein, 6 aa, Artificial Sequence
  Synthetic Construct
SDSYWS

SEQ ID NO: 1213 - DNA, 48 bp, Artificial Sequence; identical to SEQ ID NO: 13
  Synthetic Construct

SEQ ID NO: 1214 - protein, 16 aa, Artificial Sequence
  Synthetic Construct
YVHKSGDTNYSPSLKS

SEQ ID NO: 1215 - DNA, 72 bp, Artificial Sequence; identical to SEQ ID NO: 15
  Synthetic Construct

SEQ ID NO: 1216 - protein, 24 aa, Artificial Sequence
  Synthetic Construct
TLHGRRIYGIVAFNEWFTYFYMDV

SEQ ID NO: 1217 - DNA, 693 bp, Artificial Sequence
  Synthetic Construct
atgatgtcctttgtctctctgctcctggttggcatcctattccatgccacccaggcctccgatatatctgtggccccaggacagacggccaggatttcctgtggggaaaagagccttggaagtagagctgtacaatggtatcaacagagggccggccaggccccctctttaatcatatataataatcaggaccggccctcagggatccctgagcgattctctggctcccctgactccggatttgggaccacggccaccctgaccatcaccagtgtcgaagccggggatgaggccgactattactgtcatatatgggatagtagagttcccaccaaatgggtcttcggcggagggaccacgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1218 - protein, 230 aa, Artificial Sequence
  Synthetic Construct
MMSFVSLLLVGILFHATQASDISVAPGQTARISCGEKSLGSRAVQWYQQRAGQAPSLIIYNNQDRPSGIPERFSGSPDSGFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1219 - DNA, 33 bp, Artificial Sequence; identical to SEQ ID NO: 3
  Synthetic Construct

SEQ ID NO: 1220 - protein, 11 aa, Artificial Sequence
  Synthetic Construct
GEKSLGSRAVQ

SEQ ID NO: 1221 - DNA, 21 bp, Artificial Sequence
  Synthetic Construct
aataatcaggaccggccctca

SEQ ID NO: 1222 - protein, 7 aa, Artificial Sequence
  Synthetic Construct
NNQDRPS

SEQ ID NO: 1223 - DNA, 36 bp, Artificial Sequence; identical to SEQ ID NO: 7
  Synthetic Construct

SEQ ID NO: 1224 - protein, 12 aa, Artificial Sequence
  Synthetic Construct
HIWDSRVPTKWV

SEQ ID NO: 1225 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaatccccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcgtctattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 1226 - protein, 481 aa, Artificial Sequence
  Synthetic Construct
MMSFVSLLLVGILFHATQAQMQLQESGPGLVKPSETLSLTCSVSGASISDSYWSWIRQSPGKGLEWIGYVHKSGDTNYSPSLKSRVNLSLDTSKNQVSLSLSAATAADSGVYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1227 - DNA, 18 bp, Artificial Sequence
  Synthetic Construct
agtgacagttactggagc

SEQ ID NO: 1228 - protein, 6 aa, Artificial Sequence
  Synthetic Construct
SDSYWS

SEQ ID NO: 1229 - DNA, 48 bp, Artificial Sequence; identical to SEQ ID NO: 13
  Synthetic Construct

SEQ ID NO: 1230 - protein, 16 aa, Artificial Sequence
  Synthetic Construct
YVHKSGDTNYSPSLKS

SEQ ID NO: 1231 - DNA, 72 bp, Artificial Sequence; identical to SEQ ID NO: 15
  Synthetic Construct

SEQ ID NO: 1232 - protein, 24 aa, Artificial Sequence
  Synthetic Construct
TLHGRRIYGIVAFNEWFTYFYMDV

SEQ ID NO: 1233 - DNA, 693 bp, Artificial Sequence; identical to SEQ ID NO: 1009
  Synthetic Construct

SEQ ID NO: 1234 - protein, 230 aa, Artificial Sequence; identical to SEQ ID NO: 1010
  Synthetic Construct

SEQ ID NO: 1235 - DNA, 33 bp, Artificial Sequence; identical to SEQ ID NO: 3
  Synthetic Construct

SEQ ID NO: 1236 - protein, 11 aa, Artificial Sequence
  Synthetic Construct
GEKSLGSRAVQ

SEQ ID NO: 1237 - DNA, 21 bp, Artificial Sequence
  Synthetic Construct
aataatcaggaccggccctca

SEQ ID NO: 1238 - protein, 7 aa, Artificial Sequence
  Synthetic Construct
NNQDRPS

SEQ ID NO: 1239 - DNA, 36 bp, Artificial Sequence; identical to SEQ ID NO: 7
  Synthetic Construct

SEQ ID NO: 1240 - protein, 12 aa, Artificial Sequence
  Synthetic Construct
HIWDSRVPTKWV

SEQ ID NO: 1241 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaaccgccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcgtctattattgcgcgagaacactgcacgggaggagaatttatggaatcgttgccttcaatgagtggttcacctacttctacatggacgtctggggcaatgggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctaggtggcagcaggggaacgtcttctcatgctccgtgctccatgaggctctgcactcccactacacgcagaagagcctctccctgtctccgggtaaatga

SEQ ID NO: 1242 - protein, 481 aa, Artificial Sequence
  Synthetic Construct
MMSFVSLLLVGILFHATQAQMQLQESGPGLVKPSETLSLTCSVSGASISDSYWSWIRQPPGKGLEWIGYVHKSGDTNYSPSLKSRVNLSLDTSKNQVSLSLSAATAADSGVYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1243 - DNA, 18 bp, Artificial Sequence
  Synthetic Construct
agtgacagttactggagc

SEQ ID NO: 1244 - protein, 6 aa, Artificial Sequence
  Synthetic Construct
SDSYWS

SEQ ID NO: 1245 - DNA, 48 bp, Artificial Sequence; identical to SEQ ID NO: 13
  Synthetic Construct

SEQ ID NO: 1246 - protein, 16 aa, Artificial Sequence
  Synthetic Construct
YVHKSGDTNYSPSLKS

SEQ ID NO: 1247 - DNA, 72 bp, Artificial Sequence; identical to SEQ ID NO: 15
  Synthetic Construct

SEQ ID NO: 1248 - protein, 24 aa, Artificial Sequence
  Synthetic Construct
TLHGRRIYGIVAFNEWFTYFYMDV

SEQ ID NO: 1249 - DNA, 693 bp, Artificial Sequence; identical to SEQ ID NO: 1009
  Synthetic Construct

SEQ ID NO: 1250 - protein, 230 aa, Artificial Sequence; identical to SEQ ID NO: 1010
  Synthetic Construct

SEQ ID NO: 1251 - DNA, 33 bp, Artificial Sequence; identical to SEQ ID NO: 3
  Synthetic Construct

SEQ ID NO: 1252 - protein, 11 aa, Artificial Sequence
  Synthetic Construct
GEKSLGSRAVQ

SEQ ID NO: 1253 - DNA, 21 bp, Artificial Sequence
  Synthetic Construct
aataatcaggaccggccctca

SEQ ID NO: 1254 - protein, 7 aa, Artificial Sequence
  Synthetic Construct
NNQDRPS

SEQ ID NO: 1255 - DNA, 36 bp, Artificial Sequence; identical to SEQ ID NO: 7
  Synthetic Construct

SEQ ID NO: 1256 - protein, 12 aa, Artificial Sequence
  Synthetic Construct
HIWDSRVPTKWV

SEQ ID NO: 1257 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaatccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggccaggggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 1258 - protein, 481 aa, Artificial Sequence
  Synthetic Construct
MMSFVSLLLVGILFHATQAQMQLQESGPGLVKPSETLSLTCSVSGASISDSYWSWIRQSPGKGLEWIGYVHKSGDTNYSPSLKSRVNLSLDTSKNQVSLSLVAATAADSGKYYCARTLHGRRIYGIVAFNEWFTYFYMDVWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1259 - DNA, 18 bp, Artificial Sequence
  Synthetic Construct
agtgacagttactggagc

SEQ ID NO: 1260 - protein, 6 aa, Artificial Sequence
  Synthetic Construct
SDSYWS

SEQ ID NO: 1261 - DNA, 48 bp, Artificial Sequence; identical to SEQ ID NO: 13
  Synthetic Construct

SEQ ID NO: 1262 - protein, 16 aa, Artificial Sequence
  Synthetic Construct
YVHKSGDTNYSPSLKS

SEQ ID NO: 1263 - DNA, 72 bp, Artificial Sequence; identical to SEQ ID NO: 15
  Synthetic Construct

SEQ ID NO: 1264 - protein, 24 aa, Artificial Sequence
  Synthetic Construct
TLHGRRIYGIVAFNEWFTYFYMDV

SEQ ID NO: 1265 - DNA, 693 bp, Artificial Sequence; identical to SEQ ID NO: 65
  Synthetic Construct

SEQ ID NO: 1266 - protein, 230 aa, Artificial Sequence; identical to SEQ ID NO: 66
  Synthetic Construct

SEQ ID NO: 1267 - DNA, 33 bp, Artificial Sequence; identical to SEQ ID NO: 3
  Synthetic Construct

SEQ ID NO: 1268 - protein, 11 aa, Artificial Sequence
  Synthetic Construct
GEKSLGSRAVQ

SEQ ID NO: 1269 - DNA, 21 bp, Artificial Sequence
  Synthetic Construct
aataatcaggaccggccctca

SEQ ID NO: 1270 - protein, 7 aa, Artificial Sequence
  Synthetic Construct
NNQDRPS

SEQ ID NO: 1271 - DNA, 36 bp, Artificial Sequence; identical to SEQ ID NO: 7
  Synthetic Construct

SEQ ID NO: 1272 - protein, 12 aa, Artificial Sequence
  Synthetic Construct
HIWDSRVPTKWV

SEQ ID NO: 1273 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaatccccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcaaatattattgcgcgagaacactgcacgggaggagaatttatggaatcgttgccttcaatgagtggttcacctacttctacatggacgtctggggccaggggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 1274 - protein, 481 aa, Artificial Sequence
  Synthetic Construct
MMSFVSLLLVGILFHATQAQMQLQESGPGLVKPSETLSLTCSVSGASISDSYWSWIRQSPGKGLEWIGYVHKSGDTNYSPSLKSRVNLSLDTSKNQVSLSLSAATAADSGKYYCARTLHGRRIYGIVAFNEWFTYFYMDVWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1275 - DNA, 18 bp, Artificial Sequence
  Synthetic Construct
agtgacagttactggagc

SEQ ID NO: 1276 - protein, 6 aa, Artificial Sequence
  Synthetic Construct
SDSYWS

SEQ ID NO: 1277 - DNA, 48 bp, Artificial Sequence; identical to SEQ ID NO: 13
  Synthetic Construct

SEQ ID NO: 1278 - protein, 16 aa, Artificial Sequence
  Synthetic Construct
YVHKSGDTNYSPSLKS

SEQ ID NO: 1279 - DNA, 72 bp, Artificial Sequence; identical to SEQ ID NO: 15
  Synthetic Construct

SEQ ID NO: 1280 - protein, 24 aa, Artificial Sequence
  Synthetic Construct
TLHGRRIYGIVAFNEWFTYFYMDV

SEQ ID NO: 1281 - DNA, 693 bp, Artificial Sequence; identical to SEQ ID NO: 1025
  Synthetic Construct

SEQ ID NO: 1282 - protein, 230 aa, Artificial Sequence; identical to SEQ ID NO: 1026
  Synthetic Construct

SEQ ID NO: 1283 - DNA, 33 bp, Artificial Sequence; identical to SEQ ID NO: 3
  Synthetic Construct

SEQ ID NO: 1284 - protein, 11 aa, Artificial Sequence
  Synthetic Construct
GEKSLGSRAVQ

SEQ ID NO: 1285 - DNA, 21 bp, Artificial Sequence
  Synthetic Construct
aataatcaggaccggccctca

SEQ ID NO: 1286 - protein, 7 aa, Artificial Sequence
  Synthetic Construct
NNQDRPS

SEQ ID NO: 1287 - DNA, 36 bp, Artificial Sequence; identical to SEQ ID NO: 7
  Synthetic Construct

SEQ ID NO: 1288 - protein, 12 aa, Artificial Sequence
  Synthetic Construct
HIWDSRVPTKWV

SEQ ID NO: 1289 - DNA, 1446 bp, Artificial Sequence; identical to SEQ ID NO: 1257
  Synthetic Construct

SEQ ID NO: 1290 - protein, 481 aa, Artificial Sequence; identical to SEQ ID NO: 1258
  Synthetic Construct

SEQ ID NO: 1291 - DNA, 18 bp, Artificial Sequence
  Synthetic Construct
agtgacagttactggagc

SEQ ID NO: 1292 - protein, 6 aa, Artificial Sequence
  Synthetic Construct
SDSYWS

SEQ ID NO: 1293 - DNA, 48 bp, Artificial Sequence; identical to SEQ ID NO: 13
  Synthetic Construct

SEQ ID NO: 1294 - protein, 16 aa, Artificial Sequence
  Synthetic Construct
YVHKSGDTNYSPSLKS

SEQ ID NO: 1295 - DNA, 72 bp, Artificial Sequence; identical to SEQ ID NO: 15
  Synthetic Construct

SEQ ID NO: 1296 - protein, 24 aa, Artificial Sequence
  Synthetic Construct
TLHGRRIYGIVAFNEWFTYFYMDV

SEQ ID NO: 1297 - DNA, 693 bp, Artificial Sequence; identical to SEQ ID NO: 1025
  Synthetic Construct

SEQ ID NO: 1298 - protein, 230 aa, Artificial Sequence; identical to SEQ ID NO: 1026
  Synthetic Construct

SEQ ID NO: 1299 - DNA, 33 bp, Artificial Sequence; identical to SEQ ID NO: 3
  Synthetic Construct

SEQ ID NO: 1300 - protein, 11 aa, Artificial Sequence
  Synthetic Construct
GEKSLGSRAVQ

SEQ ID NO: 1301 - DNA, 21 bp, Artificial Sequence
  Synthetic Construct
aataatcaggaccggccctca

SEQ ID NO: 1302 - protein, 7 aa, Artificial Sequence
  Synthetic Construct
NNQDRPS

SEQ ID NO: 1303 - DNA, 36 bp, Artificial Sequence; identical to SEQ ID NO: 7
  Synthetic Construct

SEQ ID NO: 1304 - protein, 12 aa, Artificial Sequence
  Synthetic Construct
HIWDSRVPTKWV

SEQ ID NO: 1305 - DNA, 1446 bp, Artificial Sequence; identical to SEQ ID NO: 1273
  Synthetic Construct

SEQ ID NO: 1306 - protein, 481 aa, Artificial Sequence; identical to SEQ ID NO: 1274
  Synthetic Construct

SEQ ID NO: 1307 - DNA, 18 bp, Artificial Sequence
  Synthetic Construct
agtgacagttactggagc

SEQ ID NO: 1308 - protein, 6 aa, Artificial Sequence
  Synthetic Construct
SDSYWS

SEQ ID NO: 1309 - DNA, 48 bp, Artificial Sequence; identical to SEQ ID NO: 13
  Synthetic Construct

SEQ ID NO: 1310 - protein, 16 aa, Artificial Sequence
  Synthetic Construct
YVHKSGDTNYSPSLKS

SEQ ID NO: 1311 - DNA, 72 bp, Artificial Sequence; identical to SEQ ID NO: 15
  Synthetic Construct

SEQ ID NO: 1312 - protein, 24 aa, Artificial Sequence
  Synthetic Construct
TLHGRRIYGIVAFNEWFTYFYMDV

SEQ ID NO: 1313 - DNA, 693 bp, Artificial Sequence; identical to SEQ ID NO: 1121
  Synthetic Construct

SEQ ID NO: 1314 - protein, 230 aa, Artificial Sequence; identical to SEQ ID NO: 1122
  Synthetic Construct

SEQ ID NO: 1315 - DNA, 33 bp, Artificial Sequence; identical to SEQ ID NO: 3
  Synthetic Construct

SEQ ID NO: 1316 - protein, 11 aa, Artificial Sequence
  Synthetic Construct
GEKSLGSRAVQ

SEQ ID NO: 1317 - DNA, 21 bp, Artificial Sequence
  Synthetic Construct
aataatcaggaccggccctca

SEQ ID NO: 1318 - protein, 7 aa, Artificial Sequence
  Synthetic Construct
NNQDRPS

SEQ ID NO: 1319 - DNA, 36 bp, Artificial Sequence; identical to SEQ ID NO: 7
  Synthetic Construct

SEQ ID NO: 1320 - protein, 12 aa, Artificial Sequence
  Synthetic Construct
HIWDSRVPTKWV

SEQ ID NO: 1321 - DNA, 1446 bp, Artificial Sequence; identical to SEQ ID NO: 1257
  Synthetic Construct

SEQ ID NO: 1322 - protein, 481 aa, Artificial Sequence; identical to SEQ ID NO: 1258
  Synthetic Construct

SEQ ID NO: 1323 - DNA, 18 bp, Artificial Sequence
  Synthetic Construct
agtgacagttactggagc

SEQ ID NO: 1324 - protein, 6 aa, Artificial Sequence
  Synthetic Construct
SDSYWS

SEQ ID NO: 1325 - DNA, 48 bp, Artificial Sequence; identical to SEQ ID NO: 13
  Synthetic Construct

SEQ ID NO: 1326 - protein, 16 aa, Artificial Sequence
  Synthetic Construct
YVHKSGDTNYSPSLKS

SEQ ID NO: 1327 - DNA, 72 bp, Artificial Sequence; identical to SEQ ID NO: 15
  Synthetic Construct

SEQ ID NO: 1328 - protein, 24 aa, Artificial Sequence
  Synthetic Construct
TLHGRRIYGIVAFNEWFTYFYMDV

SEQ ID NO: 1329 - DNA, 693 bp, Artificial Sequence; identical to SEQ ID NO: 1009
  Synthetic Construct

SEQ ID NO: 1330 - protein, 230 aa, Artificial Sequence; identical to SEQ ID NO: 1010
  Synthetic Construct

SEQ ID NO: 1331 - DNA, 33 bp, Artificial Sequence; identical to SEQ ID NO: 3
  Synthetic Construct

SEQ ID NO: 1332 - protein, 11 aa, Artificial Sequence
  Synthetic Construct
GEKSLGSRAVQ

SEQ ID NO: 1333 - DNA, 21 bp, Artificial Sequence
  Synthetic Construct
aataatcaggaccggccctca

SEQ ID NO: 1334 - protein, 7 aa, Artificial Sequence
  Synthetic Construct
NNQDRPS

SEQ ID NO: 1335 - DNA, 36 bp, Artificial Sequence; identical to SEQ ID NO: 7
  Synthetic Construct

SEQ ID NO: 1336 - protein, 12 aa, Artificial Sequence
  Synthetic Construct
HIWDSRVPTKWV

SEQ ID NO: 1337 - DNA, 1446 bp, Artificial Sequence; identical to SEQ ID NO: 1273
  Synthetic Construct

SEQ ID NO: 1338 - protein, 481 aa, Artificial Sequence; identical to SEQ ID NO: 1274
  Synthetic Construct

SEQ ID NO: 1339 - DNA, 18 bp, Artificial Sequence
  Synthetic Construct
agtgacagttactggagc

SEQ ID NO: 1340 - protein, 6 aa, Artificial Sequence
  Synthetic Construct
SDSYWS

SEQ ID NO: 1341 - DNA, 48 bp, Artificial Sequence; identical to SEQ ID NO: 13
  Synthetic Construct

SEQ ID NO: 1342 - protein, 16 aa, Artificial Sequence
  Synthetic Construct
YVHKSGDTNYSPSLKS

SEQ ID NO: 1343 - DNA, 72 bp, Artificial Sequence; identical to SEQ ID NO: 15
  Synthetic Construct

SEQ ID NO: 1344 - protein, 24 aa, Artificial Sequence
  Synthetic Construct
TLHGRRIYGIVAFNEWFTYFYMDV

SEQ ID NO: 1345 - DNA, 693 bp, Artificial Sequence; identical to SEQ ID NO: 1121
  Synthetic Construct

SEQ ID NO: 1346 - protein, 230 aa, Artificial Sequence; identical to SEQ ID NO: 1122
  Synthetic Construct

SEQ ID NO: 1347 - DNA, 33 bp, Artificial Sequence; identical to SEQ ID NO: 3
  Synthetic Construct

SEQ ID NO: 1348 - protein, 11 aa, Artificial Sequence
  Synthetic Construct
GEKSLGSRAVQ

SEQ ID NO: 1349 - DNA, 21 bp, Artificial Sequence
  Synthetic Construct
aataatcaggaccggccctca

SEQ ID NO: 1350 - protein, 7 aa, Artificial Sequence
  Synthetic Construct
NNQDRPS

SEQ ID NO: 1351 - DNA, 36 bp, Artificial Sequence; identical to SEQ ID NO: 7
  Synthetic Construct

SEQ ID NO: 1352 - protein, 12 aa, Artificial Sequence
  Synthetic Construct
HIWDSRVPTKWV

SEQ ID NO: 1353 - DNA, 1446 bp, Artificial Sequence; identical to SEQ ID NO: 1273
  Synthetic Construct

SEQ ID NO: 1354 - protein, 481 aa, Artificial Sequence; identical to SEQ ID NO: 1274
  Synthetic Construct

SEQ ID NO: 1355 - DNA, 18 bp, Artificial Sequence
  Synthetic Construct
agtgacagttactggagc

SEQ ID NO: 1356 - protein, 6 aa, Artificial Sequence
  Synthetic Construct
SDSYWS

SEQ ID NO: 1357 - DNA, 48 bp, Artificial Sequence; identical to SEQ ID NO: 13
  Synthetic Construct

SEQ ID NO: 1358 - protein, 16 aa, Artificial Sequence
  Synthetic Construct
YVHKSGDTNYSPSLKS

SEQ ID NO: 1359 - DNA, 72 bp, Artificial Sequence; identical to SEQ ID NO: 15
  Synthetic Construct

SEQ ID NO: 1360 - protein, 24 aa, Artificial Sequence
  Synthetic Construct
TLHGRRIYGIVAFNEWFTYFYMDV

SEQ ID NO: 1361 - DNA, 693 bp, Artificial Sequence; identical to SEQ ID NO: 1009
  Synthetic Construct

SEQ ID NO: 1362 - protein, 230 aa, Artificial Sequence; identical to SEQ ID NO: 1010
  Synthetic Construct

SEQ ID NO: 1363 - DNA, 33 bp, Artificial Sequence; identical to SEQ ID NO: 3
  Synthetic Construct

SEQ ID NO: 1364 - protein, 11 aa, Artificial Sequence
  Synthetic Construct
GEKSLGSRAVQ

SEQ ID NO: 1365 - DNA, 21 bp, Artificial Sequence
  Synthetic Construct
aataatcaggaccggccctca

SEQ ID NO: 1366 - protein, 7 aa, Artificial Sequence
  Synthetic Construct
NNQDRPS

SEQ ID NO: 1367 - DNA, 36 bp, Artificial Sequence; identical to SEQ ID NO: 7
  Synthetic Construct

SEQ ID NO: 1368 - protein, 12 aa, Artificial Sequence
  Synthetic Construct
HIWDSRVPTKWV

SEQ ID NO: 1369 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaaccgccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcgtctattattgcgcgagaacactgcacgggaggagaatttatggaatcgttgccttcaatgagtggttcacctacttctacatggacgtctggggccaggggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctaggtggcagcaggggaacgtcttctcatgctccgtgctccatgaggctctgcactcccactacacgcagaagagcctctccctgtctccgggtaaatga

SEQ ID NO: 1370 - protein, 481 aa, Artificial Sequence
  Synthetic Construct
MMSFVSLLLVGILFHATQAQMQLQESGPGLVKPSETLSLTCSVSGASISDSYWSWIRQPPGKGLEWIGYVHKSGDTNYSPSLKSRVNLSLDTSKNQVSLSLSAATAADSGVYYCARTLHGRRIYGIVAFNEWFTYFYMDVWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1371 - DNA, 18 bp, Artificial Sequence
  Synthetic Construct
agtgacagttactggagc

SEQ ID NO: 1372 - protein, 6 aa, Artificial Sequence
  Synthetic Construct
SDSYWS

SEQ ID NO: 1373 - DNA, 48 bp, Artificial Sequence; identical to SEQ ID NO: 13
  Synthetic Construct

SEQ ID NO: 1374 - protein, 16 aa, Artificial Sequence
  Synthetic Construct
YVHKSGDTNYSPSLKS

SEQ ID NO: 1375 - DNA, 72 bp, Artificial Sequence; identical to SEQ ID NO: 15
  Synthetic Construct

SEQ ID NO: 1376 - protein, 24 aa, Artificial Sequence
  Synthetic Construct
TLHGRRIYGIVAFNEWFTYFYMDV

SEQ ID NO: 1377 - DNA, 693 bp, Artificial Sequence; identical to SEQ ID NO: 1217
  Synthetic Construct

SEQ ID NO: 1378 - protein, 230 aa, Artificial Sequence; identical to SEQ ID NO: 1218
  Synthetic Construct

SEQ ID NO: 1379 - DNA, 33 bp, Artificial Sequence; identical to SEQ ID NO: 3
  Synthetic Construct

SEQ ID NO: 1380 - protein, 11 aa, Artificial Sequence
  Synthetic Construct
GEKSLGSRAVQ

SEQ ID NO: 1381 - DNA, 21 bp, Artificial Sequence
  Synthetic Construct
aataatcaggaccggccctca

SEQ ID NO: 1382 - protein, 7 aa, Artificial Sequence
  Synthetic Construct
NNQDRPS

SEQ ID NO: 1383 - DNA, 36 bp, Artificial Sequence; identical to SEQ ID NO: 7
  Synthetic Construct

SEQ ID NO: 1384 - protein, 12 aa, Artificial Sequence
  Synthetic Construct
HIWDSRVPTKWV

SEQ ID NO: 1385 - DNA, 1446 bp, Artificial Sequence
  Synthetic Construct
atgatgtcctttgtctctctgctcctggttggcatcctattccatgccacccaggcccagatgcagttacaggagtcgggccccggactggtgaagccttcggaaaccctgtccctcacgtgcagtgtgtctggtgcctccataagtgacagttactggagctggatccggcaatccccagggaagggacttgagtggattgggtatgtccacaaaagcggcgacacaaattacagcccctccctcaagagtcgagtcaacttgtcgttagacacgtccaaaaatcaggtgtccctgagcctttctgccgcgaccgctgcggactcgggcgtctattattgcgcgagaacactgcacgggaggagaatttatggaatcgttgccttcaatgagtggttcacctacttctacatggacgtctggggccaggggactcaggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgctccatgaggctctgcactcccactacacgcagaagagcctctccctgtctccgggtaaatga

SEQ ID NO: 1386 - protein, 481 aa, Artificial Sequence
  Synthetic Construct
MMSFVSLLLVGILFHATQAQMQLQESGPGLVKPSETLSLTCSVSGASISDSYWSWIRQSPGKGLEWIGYVHKSGDTNYSPSLKSRVNLSLDTSKNQVSLSLSAATAADSGVYYCARTLHGRRIYGIVAFNEWFTYFYMDVWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1387 - DNA, 18 bp, Artificial Sequence
  Synthetic Construct
agtgacagttactggagc

SEQ ID NO: 1388 - protein, 6 aa, Artificial Sequence
  Synthetic Construct
SDSYWS

SEQ ID NO: 1389 - DNA, 48 bp, Artificial Sequence; identical to SEQ ID NO: 13
  Synthetic Construct

SEQ ID NO: 1390 - protein, 16 aa, Artificial Sequence
  Synthetic Construct
YVHKSGDTNYSPSLKS

SEQ ID NO: 1391 - DNA, 72 bp, Artificial Sequence; identical to SEQ ID NO: 15
  Synthetic Construct

SEQ ID NO: 1392 - protein, 24 aa, Artificial Sequence
  Synthetic Construct
TLHGRRIYGIVAFNEWFTYFYMDV

SEQ ID NO: 1393 - protein, 132 aa, Artificial Sequence
  Synthetic Peptide
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 1394 - protein, 105 aa, Artificial Sequence
  Synthetic Peptide
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVL

SEQ ID NO: 1395 - protein, 5 aa, Artificial Sequence
  Synthetic Peptide
DSYWS

SEQ ID NO: 1396 - protein, 16 aa, Artificial Sequence
  Synthetic Peptide
YVHKSGDTNYSPSLKS

SEQ ID NO: 1397 - protein, 24 aa, Artificial Sequence
  Synthetic Peptide
TLHGRRIYGIVAFNEWFTYFYMDV

SEQ ID NO: 1398 - protein, 11 aa, Artificial Sequence
  Synthetic Peptide
GEKSLGSRAVQ

SEQ ID NO: 1399 - protein, 7 aa, Artificial Sequence
  Synthetic Peptide
NNQDRPS

SEQ ID NO: 1400 - protein, 12 aa, Artificial Sequence
  Synthetic Peptide
HIWDSRVPTKWV

SEQ ID NO: 1401 - protein, 103 aa, Artificial Sequence
  Synthetic Construct
QPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLS

SEQ ID NO: 1402 - protein, 103 aa, Artificial Sequence
  Synthetic Construct
QPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLS

SEQ ID NO: 1403 - protein, 105 aa, Artificial Sequence
  Synthetic Construct
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKG

SEQ ID NO: 1404 - protein, 208 aa, Artificial Sequence
  Synthetic Construct
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLS

SEQ ID NO: 1405 - protein, 208 aa, Artificial Sequence
  Synthetic Construct
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLS

SEQ ID NO: 1406 - protein, 98 aa, Artificial Sequence
  Synthetic Construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 1407 - protein, 21 aa, Artificial Sequence
  Synthetic Construct
EPKSCDKTHTCPPCPAPELLG

The invention claimed is:

1. An antibody or antigen-binding fragment thereof comprising:
   (a) a heavy chain variable domain comprising a sequence with at least 90% sequence identity to SEQ ID NO: 1393, wherein the heavy chain variable domain sequence comprises:
      (i) a heavy chain (HC)-complementary determining region (CDR) sequence (HC-CDR1) comprising the amino acid sequence of SEQ ID NO: 1244, a HC-CDR2 comprising the amino acid sequence of SEQ ID NO: 1246, and a HC-CDR3 comprising the amino acid sequence of SEQ ID NO: 1248; and
      (ii) at least one of the following mutations: A27G, D31E, D31S, 540P, D56E, D56S, N68T, V78F, S81K, V83S, A84S, K92V, and N124Q;
      wherein the at least 90% sequence identity occurs within a framework (FR) region of the heavy chain variable domain; and
   (b) a light chain variable domain comprising a sequence with at least 90% sequence identity to SEQ ID NO: 1394, wherein the light chain variable domain sequence comprises:
      (i) a light chain (LC)-CDR sequence (LC-CDR1) comprising the amino acid sequence of SEQ ID NO: 1236, a LC-CDR2 comprising the amino acid sequence of SEQ ID NO: 1238, and a LC-CDR3 comprising the amino acid sequence of SEQ ID NO: 1240; and
      (ii) at least one of the following mutations: S1P, D2S, E9Q, S37V, P58S, P61G, S72G, D87E, and T101K, wherein the at least 90% sequence identity occurs within a FR region of the light chain variable domain.

2. The antibody or antigen-binding fragment thereof of claim 1, wherein the antibody or antigen-binding fragment thereof comprises and/or an Fc domain comprising the amino acid sequence of SEQ ID NO: 1401 or 1402.

3. The antibody or antigen-binding fragment thereof of claim 1, wherein the antibody or antigen-binding fragment thereof exhibits one or more of the following properties:
   (i) neutralization of one or more of the following pseudoviruses of human immunodeficiency virus (HIV): RHPA4259.7, Du172.17, CNE52, 0260.v5.c36, SC05.8C11.2344, Ce1176_A3, SC422661.8, BB1012-11.TC21, 263-8, X1193_c1, AC10.0.29, and 6952.v1.c20;
   (ii) increased solubility in a PEG 10,000 concentration of 6-9%;
   (iii) increased stability at a pH less than pH 5.0;
   (iv) increased thermal stability at a temperature in the range of 20-95° C.; and/or
   (v) increased resistance to chemical denaturation by at least 3M guanidine hydrochloride (GuHCl) or greater, as compared to an antibody or antigen-binding fragment thereof lacking the at least one mutation in the heavy chain variable domain and/or the light chain variable domain.

4. The antibody or antigen-binding fragment thereof of claim 1, wherein the antibody or antigen-binding fragment thereof exhibits one or more of the following properties:
   (i) increased storage stability, wherein the antibody or antigen-binding fragment thereof exhibits no or reduced aggregation during storage over time; and/or
   (ii) the antibody or antigen-binding fragment thereof exhibits no or reduced aggregation during storage at a temperature of about −40° C. to 50° C.; and/or
   (iii) a percent oligomer increase of the antibody or antigen-binding fragment thereof during storage is less than about 1%; and/or
   (iv) the antibody or antigen-binding fragment thereof exhibits more than about 60% high monomer content and/or less than about 10% low oligomer content.

5. The antibody or antigen-binding fragment thereof of claim 1, wherein the antibody or antigen-binding fragment thereof exhibits one or more of the following properties:
   (i) does not aggregate during manufacture; and/or
   (ii) a half-life in a fluid of at least about 1 hour to about 28 days in vitro or in vivo.

6. The antibody or antigen-binding fragment thereof of claim 1, wherein the antibody or antigen-binding fragment thereof is selected from the group consisting of a monoclonal antibody or antigen-binding fragment thereof, a polyclonal antibody or antigen-binding fragment thereof, a human antibody or antigen-binding fragment thereof, a humanized antibody or antigen-binding fragment thereof, a primatized antibody or antigen-binding fragment thereof, a bispecific antibody or antigen-binding fragment thereof, a multi-specific antibody or antigen-binding fragment thereof, a dual-variable immunoglobulin domain, a monovalent antibody or antigen-binding fragment thereof, a chimeric antibody or antigen-binding fragment thereof, a single-chain Fv molecule (scFv), a diabody, a triabody, a nanobody, an antibody-like protein scaffold, a domain antibody, a Fv fragment, a Fab fragment, a F(ab')2 molecule, and a tandem scFv (taFv).

7. A composition comprising the antibody or antigen-binding fragment thereof of claim 1.

8. The composition of claim 7, wherein:
(a) the composition further comprises:
   (i) a pharmaceutically acceptable carrier, excipient, or diluent;
   (ii) an immunomodulator; and/or at least one reservoir activator;
   (iii) an antiretroviral agent (ARV); and/or
   (iv) one, two, three, or more different HIV-specific broadly neutralizing antibodies (bnAb);
   or the antibody or antigen-binding fragment thereof is present in the composition in an amount of about 0.01 mg to about 5000 mg.

9. The composition of claim 8, wherein:
(a) the composition is formulated for subcutaneous, intramuscular, intradermal, transdermal, intranasal, or oral administration, or administration as an infusion; and/or
(b) said composition is formulated in a volume of about 1000 ml or less.

10. The antibody or antigen-binding fragment thereof of claim 1, wherein the heavy chain variable domain sequence comprises a R39Q mutation and the light chain variable domain sequence comprises a H300 mutation.

11. The antibody or antigen-binding fragment thereof of claim 1, wherein the heavy chain variable domain sequence has at least 95% sequence identity to SEQ ID NO: 1393 and the light chain variable domain sequence has at least 95% sequence identity to SEQ ID NO: 1394.

12. The antibody or antigen-binding fragment thereof of claim 1, wherein the heavy chain variable domain sequence has at least 99% sequence identity to SEQ ID NO: 1393 and the light chain variable domain sequence has at least 99% sequence identity to SEQ ID NO: 1394.

13. The antibody or antigen-binding fragment thereof of claim 1, wherein the heavy chain variable domain comprises an amino acid sequence of amino acids 20-481 of SEQ ID NO: 1242 and the light chain variable domain comprises and amino acid sequence of amino acids 20-230 of SEQ ID NO: 1234.

* * * * *